(12) United States Patent
Zhang et al.

(10) Patent No.: US 12,110,490 B2
(45) Date of Patent: *Oct. 8, 2024

(54) CRISPR ENZYMES AND SYSTEMS

(71) Applicants: The Broad Institute, Inc., Cambridge, MA (US); Massachusetts Institute of Technology, Cambridge, MA (US); President and Fellows of Harvard College, Cambridge, MA (US)

(72) Inventors: Feng Zhang, Cambridge, MA (US); Bernd Zetsche, Gloucester, MA (US); Fei Ran, Boston, MA (US); James E. Dahlman, Cambridge, MA (US)

(73) Assignees: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

( * ) Notice: Subject to any disclaimer, the term of this patent is extended or adjusted under 35 U.S.C. 154(b) by 701 days.

This patent is subject to a terminal disclaimer.

(21) Appl. No.: 16/063,643

(22) PCT Filed: Dec. 16, 2016

(86) PCT No.: PCT/US2016/067201
§ 371 (c)(1),
(2) Date: Jun. 18, 2018

(87) PCT Pub. No.: WO2017/106657
PCT Pub. Date: Jun. 22, 2017

(65) Prior Publication Data
US 2019/0233814 A1 Aug. 1, 2019

Related U.S. Application Data

(60) Provisional application No. 62/324,811, filed on Apr. 19, 2016, provisional application No. 62/269,860, filed on Dec. 18, 2015.

(51) Int. Cl.
| | | |
|---|---|---|
| *C12N 15/00* | (2006.01) | |
| *C12N 9/22* | (2006.01) | |
| *C12N 15/10* | (2006.01) | |
| *C12N 15/11* | (2006.01) | |
| *C12N 15/90* | (2006.01) | |

(52) U.S. Cl.
CPC .............. *C12N 15/111* (2013.01); *C12N 9/22* (2013.01); *C12N 15/102* (2013.01); *C12N 15/902* (2013.01); *C12N 2310/20* (2017.05)

(58) Field of Classification Search
CPC ...... C12N 15/111; C12N 9/22; C12N 15/102; C12N 15/902; C12N 2310/20
See application file for complete search history.

(56) References Cited

U.S. PATENT DOCUMENTS

| | | |
|---|---|---|
| 8,361,725 B2 | 1/2013 | Russell et al. |
| 8,697,359 B1 | 4/2014 | Zhang |
| 8,889,356 B2 | 11/2014 | Zhang |
| 9,790,490 B2 | 10/2017 | Zhang et al. |
| 10,253,365 B1 | 4/2019 | Doudna et al. |
| 10,648,020 B2 | 5/2020 | Zhang et al. |
| 10,669,540 B2 | 6/2020 | Zhang et al. |
| 11,091,798 B2 | 8/2021 | Zhang et al. |
| 11,286,478 B2 | 3/2022 | Zhang et al. |
| 2014/0242699 A1 | 8/2014 | Zhang |
| 2014/0356956 A1 | 12/2014 | Church et al. |
| 2015/0079681 A1 | 3/2015 | Zhang |
| 2016/0208243 A1 | 7/2016 | Zhang et al. |
| 2017/0233756 A1 | 8/2017 | Begemann et al. |
| 2018/0282713 A1 | 10/2018 | Van Der Oost |
| 2019/0083656 A1* | 3/2019 | Khalili ............... A61K 48/0066 |
| 2019/0218602 A1 | 7/2019 | Zhang et al. |
| 2019/0233814 A1 | 8/2019 | Zhang et al. |
| 2019/0256900 A1 | 8/2019 | Zhang et al. |
| 2019/0264186 A1 | 8/2019 | Yamano et al. |
| 2020/0080112 A1 | 3/2020 | Zhang et al. |
| 2020/0181623 A1 | 6/2020 | Zhang |
| 2020/0263190 A1 | 8/2020 | Zhang et al. |
| 2020/0283755 A1 | 9/2020 | Zhang et al. |
| 2020/0318172 A1 | 10/2020 | Zhang et al. |
| 2020/0318173 A1 | 10/2020 | Zhang et al. |

(Continued)

FOREIGN PATENT DOCUMENTS

| | | |
|---|---|---|
| CN | 103261213 A | 8/2013 |
| CN | 104017821 A | 9/2014 |

(Continued)

OTHER PUBLICATIONS

Zetsche et al entitled "Cpf1 Is a Single RNA-Guided Endonuclease of a Class 2 CRISPR-Cas System" (Cell 2015, vol. 163, published Oct. 22, 2015, pp. 759-771. (Year: 2015).*
Zetsche et al. (Cell vol. 163, pp. 759-771, Oct. 22, 2015; Available online Sep. 25, 2015; IDS ref.). (Year: 2015).*
Leford (Nature vol. 526, Oct. 1, 2015, p. 17. (Year: 2015).*
Konermann et al. (Nature, 2015, 517, pp. 583-588) . (Year: 2015).*
3rd Party Citation D46 from EP Opposition Proceedings for EP Pat. No. 3009511—Barrangou, "Class 2 large effector protein architectures", PowerPoint Presentation Slide, Jun. 20, 2015, 1 page.

(Continued)

*Primary Examiner* — Catherine S Hibbert
(74) *Attorney, Agent, or Firm* — FOLEY & LARDNER LLP

(57) ABSTRACT

The invention provides for systems, methods, and compositions for targeting nucleic acids. In particular, the invention provides non-naturally occurring or engineered DNA or RNA-targeting systems comprising a novel DNA or RNA-targeting CRISPR effector protein and at least one targeting nucleic acid component like a guide RNA.

33 Claims, 330 Drawing Sheets
Specification includes a Sequence Listing.

(56) References Cited

U.S. PATENT DOCUMENTS

| | | |
|---|---|---|
| 2021/0040546 A1 | 2/2021 | Zhang et al. |
| 2021/0076366 A1 | 3/2021 | Jang et al. |
| 2021/0155911 A1 | 5/2021 | Zhang et al. |
| 2022/0162584 A1 | 5/2022 | Zhang et al. |
| 2022/0195503 A1 | 6/2022 | Zhang et al. |

FOREIGN PATENT DOCUMENTS

| | | | |
|---|---|---|---|
| CN | 105602993 | A | 5/2016 |
| CN | 106536729 | A | 3/2017 |
| EP | 3 009 511 | A2 | 4/2016 |
| GB | 1506509.7 | | 4/2016 |
| RU | 2501850 | C2 | 4/2009 |
| TW | 201425580 | A | 7/2014 |
| WO | WO-2014/093622 | A2 | 6/2014 |
| WO | WO-2014/093712 | A1 | 6/2014 |
| WO | WO-2014/118272 | A1 | 8/2014 |
| WO | WO-2014/191521 | A2 | 12/2014 |
| WO | WO-2014/197568 | A2 | 12/2014 |
| WO | WO-2014/197748 | A2 | 12/2014 |
| WO | WO-2014/204723 | A1 | 12/2014 |
| WO | WO-2014/204724 | A1 | 12/2014 |
| WO | WO-2015/035139 | A2 | 3/2015 |
| WO | WO-2015/089364 | | 6/2015 |
| WO | WO-2015/089419 | | 6/2015 |
| WO | WO-2015/089473 | A1 | 6/2015 |
| WO | WO-2015/089486 | A2 | 6/2015 |
| WO | WO-2016/049258 | A2 | 3/2016 |
| WO | WO-2016/094872 | A1 | 6/2016 |
| WO | WO-2016/166340 | A1 | 10/2016 |
| WO | WO-2016/201155 | A1 | 12/2016 |
| WO | WO-2016/205711 | | 12/2016 |
| WO | WO-2016/205749 | | 12/2016 |
| WO | WO-2016/205764 | | 12/2016 |
| WO | WO-2017/064546 | A1 | 4/2017 |
| WO | WO-2017/106657 | | 6/2017 |
| WO | WO-2017/127807 | A1 | 7/2017 |

OTHER PUBLICATIONS

3rd Party Citation D47 from EP Opposition Proceedings for EP Pat. No. 3009511—CRIPSR Conference 2015, Website Print-out of Event Announcement, New York, New York, Jun. 18-20, 2015, accessed at https://web.archive.org/web/20150708120205/https://www.crispr2015.com/ on Jul. 30, 2019, 1 page.

3rd Party Citation D48 from EP Opposition Proceedings for EP Pat. No. 3009511—CRIPSR Conference 2015, Conference Program including Schedule of Events, New York, New York, Jun. 18-20, 2015, accessible at https://web.archive.org/web/20151109114832/http://nebula.wsimg.com/f9aa9f29c2be9e03bc66d1da9e0f2634?AccessKeyId=377234A383373D636692&disposition=0&alloworigin=1, 8 pages.

3rd Party Citation D49 from EP Opposition Proceedings for EP Pat. No. 3009511—Barrangou, et al., "Class 2 large effector protein architectures", Caribou Biosciences Mail—New Systems with PowerPoint Presentation Slide, Jun. 20, 2015, 2 pages.

3rd Party Citation D50 from EP Opposition Proceedings for EP Pat. No. 3009511—Declaration of Prof. Dr. Rodolophe Barrangou with Appendices, Aug. 13, 2019, 33 pages.

3rd Party Citation D51 from EP Opposition Proceedings for EP Pat. No. 3009511—Declaration of Andrew P. May DPhil with Appendices, Aug. 9, 2019, 24 pages.

3rd Party Citation D52 from EP Opposition Proceedings for EP Pat. No. 3009511—Declaration of Rachel E. Haurwitz, PH.D. with Appendices, Aug. 13, 2019, 8 pages.

Assignment from Bernd Zetsche to The Broad Institute Inc. for U.S. Appl. No. 14/975,085 dated Jan. 5, 2016, 2 pages.

Assignment from Feng Zhang to The Broad Institute Inc. for U.S. Appl. No. 14/975,085 dated Dec. 23, 2015, 2 pages.

Assignment from Ian Slaymaker to The Broad Institute Inc. for U.S. Appl. No. 14/975,085 dated Jan. 6, 2016, 2 pages.

Assignments from Inventors, Ian Slaymaker, Omar O. Abudayyeh, Feng Zhang, Jonathan Gootenberg, and Bernd Zetsche to The Broad Institute Inc. or Presidents and Fellows of Harvard College for U.S. Appl. No. 14/975,085 (annex to Summons to attend oral proceedings), Jan. 30, 2017, 15 pages.

Chen et al., "Targeted activation of diverse CRISPR-Cas systems for mammalian genome editing via proximal CRISPR targeting", Nature Communications, vol. 8, Apr. 7, 2017, DOI: 10.1038/ncomms14958, pp. 1-12.

Cho, Seung Woo, et al., "Targeted genome engineering in human cells with the Cas9 RNA-guided endonuclease," Nature Biotechnology, vol. 31 pp. 230-232, including Supplementary Information, 14 pages.

Daligault et al., GenBank Accession No. AJJ47668, Feb. 9, 2015, 2 pages.

D'Astolfo et al., "Efficient Intracellular Delivery of Native Proteins", Cell, vol. 161, Apr. 23, 2015, http://dx.doi.org/10.1016/j.cell.2015.03.028, pp. 674-690.

Declaration of Steven R. Trybus in EPO opposition proceedings concerning European Patent No. 3 009 511 dated Sep. 14, 2018, 13 pages.

Expert Declaration of Dmitrij Frishman with Exhibits dated Aug. 12, 2019, 25 pages.

Fagerlund et al., "The Cpf1 CRISPR-Cas protein expands genome-editing tools", Genome Biology, vol. 16, No. 251, Nov. 7, 2015, DOI 10.1186/s13059-015-0824-9, pp. 1-3.

Graham et al., "Resources for the design of CRISPR gene editing experiments", Genome Biology, vol. 16, No. 260, Nov. 27, 2015, DOI 10.1186/s13059-015-0823-x, pp. 1-21.

Hsu, et al., "DNA targeting specificity of RNA-guided Cas9 nucleases," Nature Biotechnology, vol. 31, 2013, pp. 827-834.

Hwang W., et al., "Efficient In Vivo Genome Editing Using RNA-Guided Nucleases," Nature Biotechnology, vol. 31, No. 3, Mar. 2013, pp. 227-229 (12 pages).

Jiang et al., "Demonstration of CRISPR/Cas9/sgRNA-mediated targeted gene modification in *Arabidopsis*. tobacco, sorghum and rice", Nucleic Acids Research, vol. 41, No. 20, e188, Sep. 2, 2013, pp. 1-12.

Kim et al., "Genome-wide analysis reveals specificities of Cpf1 endonucleases in human cells", Nature Biotechnology, vol. 34, No. 8, Jun. 6, 2016 (corrected Jul. 18, 2016), pp. 863-888.

Liu et al., "C2c1-sgRNA Complex Structure Reveals RNA-Guided DNA Cleavage Mechanism", Molecular Cell, vol. 65, Jan. 19, 2017, pp. 310-322.

Liu et al., "Two Distant Catalytic Sites are Responsible for C2c2 RNase Activities", Cell, vol. 168, Jan. 12, 2017, pp. 121-134.

Lundgren et al., Methods in Molecular Biology, vol. 1311, Chapters 1 and 4, 2015, pp. 1-21 and 47-75.

Mastroianni, et al., "Group II Intron-Based Gene Targeting Reactions in Eukaryotes" Plos One, vol. 3, 2008, pp. 1-15, 15 pages. Doi:10.1371/journal.pone.0003121.

New England Biolabs, "NEBuffer 3 product information", Feb. 26, 2018, 3 pages.

Nishimasu et al., "Crystal Structure of Cas9 in Complex with Guide RNA and Target RNA," Cell, 156(5):935-49 (2014).

Nishimasu et al., "Crystal Structure of *Staphylococcus aureus* Cas9", Cell, 2015, vol. 162, pp. 1113-1126, Supplemental Information.

Prakash et al., "Targeted delivery of antisense oligonucleotides to hepatocytes using triantennary N-acetylgalactosamine improves potency 10-fold in mice", Nucleic Acids Research, vol. 42, No. 13, Jul. 3, 2014, doi: 10.1093/nar/gku531, pp. 8796-8807.

Request for Grant of a European patent for Appl. Ser. No. 16150428.7 dated Jan. 28, 2016, 6 pages.

Sadowski et al., "The sequence-structure relationship and protein function prediction", Current Opinion in Structural Biology, vol. 19 pp. 2009, 357-362 (6 pages).

Sander, et al., "CRISPR-Cas systems for editing, regulating and targeting genomes," Nature Biotechnology, vol. 32, 2014, pp. 347-355, 9 pages.

ScienceDirect Excerpt—D'Astolfo et al., "Efficient Intracellular Delivery of Native Proteins", Cell, vol. 161, Issue 3, Apr. 23, 2015, pp. 674-690 (article provided separately—excerpt 1 page only).

(56) References Cited

OTHER PUBLICATIONS

Seffernick et al., "Melamine Deaminase and Atrazine Chlorohydrolase: 98 Percent Identical but Functionally Different", Journal Bacteriology, vol. 183, 2001, 2405-2410, (6 pages).
Sequence listing filed for EP Application No. 16150428.7.
Slaymaker et al., "Rationally engineered Cas9 nucleases with improved specificity", Science, vol. 351, No. 6268, Jan. 1, 2016, pp. 84-88.
Tang et al., "Identification of Dehalobacter reductive dehalogenases that catalyse dichlorination of chloroform, 1,1,1-trichloroethane and 1,2-dichloroethane", Philosophical Transactions of the Royal Society B, vol. 368, 2013, pp. 1-10 (10 pages).
Witkowski et al., "Conversation of a β-Ketoacyl Synthase to a Malonyl Decarboxylase by Replacement of the Active-Site Cysteine with Glutamine", Biochemistry, vol. 38, 1999, p. 11643-11650.
Xie, et al. "RNA-Guided Genome Editing in Plants Using a CRISPR-Cas System" Molecular Plant, vol. 6, Nov. 2013, 1975-1983, 9 pages.
Xie, K, et al., "Boosting CRISPR/Cas9 multiplex editing capability with the endogenous tRNA-processing system", Proc. Natl. Acad. Sci. U.S.A., 2015, vol. 112. pp. 3570-3575.
Yang et al., "Making and Breaking Nucleic Acids: Two-Mg2-Ion Catalysis and Substrate Specificity", Molecular Cell, vol. 22, Apr. 7, 2006, pp. 5-13.
Yang et al., "PAM-Development Target DNA Recognition and Cleavage by C2c1 CRISPR-Cas Endonuclease", Cell, vol. 167, Dec. 15, 2016, pp. 1814-1828.
Takashi et al., "Crystal structure of Cpf1 in complex with guide RNA and target DNA", Cell, Apr. 2016, vol. 165, No. 4, pp. 949-962.
Zetsche et al., "Cpf1 is a single RNA-guided endonuclease of a class 2 CRISPR-Cas system", Cell, Oct. 2015, vol. 163, No. 3, pp. 759-771.
International Search Report Issued in International Patent Application No. PCT/US2016/067201, dated May 16, 2017.
Guo, et al., "Protein Tolerance to Random Amino Acid Change", The National Academy of Sciences, PNAS, Jun. 22, 2004, vol. 101, No. 25, pp. 9205-9210.
*Benson Hill Biosystems, Inc., Petitioner, v. The Broad Institute Inc., Presidents and Fellows of Harvard College & Massachusetts Institute of Technology*, Patent Owners, Case PGR2018-00072, U.S. Pat. No. 9,790,490 B2, Patent Trial and Appeal Board Decision Denying Institution of Post-Grant Review, entered Jan. 22, 2019, 21 pages.
Charpentier et al., "Rewriting a genome", Nature, Mar. 2013, vol. 495, 2 pages.
Dahlman et al., "Orthogonal gene knockout and activation with a catalytically active Cas9 nuclease", Nature Biotechnology, vol. 33, No. 11, Oct. 5, 2015, pp. 1159-1161, XP055381172, US.
Database UniProt [Online] "SubName: Full=CRISPR-associated protein Cpf1, subtype Prefran {ECO:0000313 | EMBL: AJJ47668. 1};", XP002760659, retrieved from EBI accession No. Uniprot: A0AOB6KQP9, Database accession No. A0A0b6kqp9 sequence, Apr. 1, 2015.
Database UniProt [Online] Nov. 30, 2010, SubName: Full =Uncharacterized protein {EC0:0000313:EMBL:EFL46285.1}; XP002769441, retrieved from EBI accession No. Uniprot: E1KQG5, Database accession No. E1KQG5.
Dickey et al., "Moraxella bovoculi hypothetical protein", Database ENA [Online] EMBL-EBI, Dec. 16, 2015, Database accession No. AKG14689, XP002772302, 3 pages.
Dickey et al., "Moraxella bovoculi hypothetical protein", Database ENA [Online] EMBL-EBI, May 5, 2015, Database accession No. AKG12737, XP002772309, 2 pages.
Dong, et al. "The crystal structure of Cpf1 in complex with CRISPR RNA," Nature, vol. 532, pp. 523-525, including Research Letter, dated 2016.
Exhibit 1001—U.S. Pat. No. 9,790,490—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1002—Prosecution History of the '490 patent—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1003—Declaration of Dr. Chase L. Beisel and accompanying Appendices A-C—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1004—Schunder et al., "First indication for a functional CRISPR/Cas system in Francisella tularensis," International Journal of Medical Microbiology, 303:51-60 (2013)—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1005—Zetsche et al., "Cpf1 Is a Single RNA-Guided Endonuclease of a Class 2 CRISPR-Cas System," Cell, 163:759-71 (2015)—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1006—Zetsche et al., "A Survey of Genome Editing Activity for 16 Cpf1 orthologs," bioRxiv, doi: https://doi.org/10.1101/134015 (2017)—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1007—Hsu et al., "Development and Applications of CRISPR-Cas9 for Genome Engineering," Cell, 157:1262-78 (2014)—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1008—Shmakov et al., "Discovery and Functional Characterization of Diverse Class 2 CRISPR-Cas Systems," Molecular Cell, 60:385-97 (2015)—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1009—Koonin et al., "Diversity, classification and evolution of CRISPR-Cas systems," Current Opinion in Microbiology, 37:67-78 (2017)—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1010—Karvelis et al., "Rapid characterization of CRISPR-Cas9 protospacer adjacent motif sequence elements," Genome Biology, 16:253, 1-13 (2015)—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1011—Lowder et al., "Rapid Evolution of Manifold CRISPR Systems for Plant Genome Editing," Frontiers in Plant Science, 7(1683):1-12 (2016)—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1012—Leenay et al., "Identifying and visualizing functional PAM diversity across CRISPR-Cas systems," Mol Cell, 62(1):137-47 (2016)—*Benson Hill Biosystems, Inc., Petitioner, v. The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1013—Makarova & Koonin, "Annotation and Classification of CRISPRCas Systems," Chapter 4 in CRISPR: Methods and Protocols, Methods in Molecular Biology, 1311:47-75 (2015)—*Benson Hill Biosystems, Inc., Petitioner, v. The Broad Institute Inc.,*

(56) References Cited

OTHER PUBLICATIONS

*Presidents and Fellows of Harvard College & Massachusetts Institute of Technology*, Patent Owners, U.S. Pat. No. 9,790,490, Petition for Post Grant Review, filed Jul. 17, 2018.
Exhibit 1014—HMM Summary Page: TIGR04330 (http://tigrfams.jcvi.org/cgibin/HmmReportPage.cgi?acc=TIGR04330) last visited Jun. 27, 2018—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1015—Begemann et al., "Characterization and Validation of a Novel Group of Type V, Class 2 Nucleases for in vivo Genome Editing," bioRxiv, doi: http://dx.doi.org/10.1101/192799 (2017)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1016—Ran et al., "In vivo genome editing using *Staphylococcus aureus* Cas 9," Nature, 520(7546):186-91 (2015)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1017—Kleinstiver et al., "Engineered CRISPR-Cas9 nucleases with altered PAM specificities," Nature, 523(7561):481-85 (2015)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1018—Gao et al., "Engineered Cpf1 variants with altered PAM specificities increase genome targeting range," Nature Biotechnology, 35(8):789-92 (2017)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1019—Stella et al., "Structure of the Cpf1 endonuclease R-loop complex after target DNA cleavage," Nature, 546(7659):559-63 (2017)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1020—Hirano et al., "Structure and Engineering of Francisella novicida Cas9," Cell, 164(5):950-61 (2016)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1021—Fieck et al., "Modifications of the *E. coli* Lac repressor for expression in eukaryotic cells: effects of nuclear signal sequences on protein activity and nuclear accumulation," Nucleic Acids Research, 20(7):1785-91 (1992)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1022—U.S. Pat. No. 8,697,359—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1023—Chiu et al., "Engineered GFP as a vital reporter in plants," Current Biology, 6(3):325-30 (1996)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1024—Mali et al., "RNA-Guided Human Genome Engineering via Cas9," Science, 339(6121):823-26 (2013)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1025—Sandy et al., "Mammalian RNAi: a practical guide," BioTechniques, 39:215-24 (2005)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1026—United States Patent Application Publication No. 2013/0302401—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1027—International Publication No. WO 2014/118272—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1028—Nair et al., "Multivalent N-Acetylgalactosamine-Conjugated siRNA Localizes in Hepatocytes and Elicits Robust RNAi-Mediated Gene Silencing," JACS, 136:16958-63 (2014)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1029—Ludlum et al., "Alkylation of Synthetic Polynucleotides," Science, 145(3630):397-99 (1964)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1030—Glen Research, The Glen Report, 19(1):1-16 (2007)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1031—El-Andaloussi et al., "Exosome-mediated delivery of siRNA in vitro and in vivo," Nat Protoc, 7(12):2112-26 (2012)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1032—Choulika et al., "Transfer of single gene-containing long terminal repeats into the genome of mammalian cells by a retroviral vector carrying the cre gene and the IoxP site," J Virol., 70(3):1792-98 (1996)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1033—Bergemann et al., "Excision of specific DNA-sequences from integrated retroviral vectors via site-specific recombination," Nucleic Acids Research, 23(21):4451-56 (1995)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1034—Dahlman et al., "In vivo endothelial siRNA delivery using polymeric nanoparticles with low molecular weight," Nat Nanotechnol., 9(8):648-55 (2014)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1035—Senis et al., "CRISPR/Cas9-mediated genome engineering: an adeno-associated viral (AAV) vector toolbox," Biotechnol J., 9(11):1402-12 (2014)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1036—Shukla et al., "Precise genome modification in the crop species *Zea mays* using zinc-finger nucleases," Nature,

(56) References Cited

OTHER PUBLICATIONS

459(7245):437-41 (2009)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1037—Jinek et al., "A programmable dual-RNA-guided DNA endonuclease in adaptive bacterial immunity," Science, 337(6069):816-21 (2012)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1038—Mojica et al., "Biological significance of a family of regularly spaced repeats in the genomes of Archaea, Bacteria and mitochondria," Mol Microbiol, 36(1):244-46 (2000)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1039—Ishino et al., "Nucleotide Sequence of the iap Gene, Responsible for Alkaline Phosphatase Isozyme Conversion in *Escherichia coli*, and Identification of the Gene Product," Journal of Bacteriology, 169(12):5429-33 (1987)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1040—Jansen et al., "Identification of genes that are associated with DNA repeats in prokaryotes," Molecular Microbiology, 43(6):1565-75 (2002)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1041—Bolotin et al., "Clustered regularly interspaced short palindrome repeats (CRISPRs) have spacers of extrachromosomal origin," Microbiology, 151(Pt 8):2551-61 (2005)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1042—Mojica et al., "Intervening sequences of regularly spaced prokaryotic repeats derive from foreign genetic elements," J Mol Evol, 60(2):174-82 (2005)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1043—Pourcel, "CRISPR elements in Yersinia pestis acquire new repeats by preferential uptake of bacteriophage DNA, and provide additional tools for evolutionary studies," Microbiology, 151(Pt 3):653-3 (2005)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1044—Barrangou et al., "CRISPR provides acquired resistance against viruses in prokaryotes," Science, 315(5819):1709-12 (2007)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1045—Haft et al., "A Guild of 45 CRISPR-Associated (Cas) Protein Families and Multiple CRISPR/Cas Subtypes Exist in Prokaryotic Genomes," PLOS Computational Biology, 1(6):474-83 (2005)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1046—Brouns et al., "Small CRISPR RNAs Guide Antiviral Defense in Prokaryotes," Science, 321(5891):960-64 (2008)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1047—Garneau et al., "The CRISPR/Cas bacterial immune system cleaves bacteriophage and plasmid DNA," Nature, 468(7320):67-71 (2010)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1048—Deveau et al., "Phage Response to CRISPR-Encoded Resistance in *Streptococcus thermophilus*," Journal of Bacteriology, 190(4):1390-1400 (2008)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1049—Mojica et al., "Short motif sequences determine the targets of the prokaryotic CRISPR defence system," Microbiology, 155(Pt3):733-40 (2009)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1050—Anders et al., "Structural basis of PAM-dependent target DNA recognition by the Cas9 endonuclease," Nature, 215(7219):569-73 (2014)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1051—Nishimasu et al., "Crystal Structure of Cas9 in Complex with Guide RNA and Target RNA," Cell, 156(5):935-49 (2014)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1052—Deltcheva et al., "CRISPR RNA maturation by trans-encoded small RNA and host factor RNase III," Nature, 471(7341): 602-07 (2011)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1053—Makarova et al., "Unification of Cas protein families and a simple scenario for the origin and evolution of CRISPR-Cas systems," Biology Direct, 6:38, pp. 1-27 (2011)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1054—Nam et al., "Cas5d protein process pre-crRNA and assembles into a Cascade-like interference complex in Subtype I-C/Dvulg CRISPR-Cas system," Structure, 20(9):1574-84 (2012)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1055—Haurwitz et al., "Sequence- and structure-specific RNA processing by a CRISPR endonuclease," Science, 329(5997):1355-58 (2010)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.
Exhibit 1056—Hatoum-Aslan et al., "Mature clustered, regularly interspaced, short palindromic repeats RNA (crRNA) length is measured by a ruler mechanism anchored at the precursor processing site," PNAS, 108(52):21218-222 (2011)—*Benson Hill Biosystems, Inc.*, Petitioner, v. *The Broad Institute Inc., Presidents and Fellows of Harvard College & Massachusetts Institute of Technology*, Patent Owners, U.S. Pat. No. 9,790,490, Petition for Post Grant Review, filed Jul. 17, 2018.

(56) References Cited

OTHER PUBLICATIONS

Exhibit 1057—Rouillon et al., "Structure of the CRISPR Interference Complex CSM Reveals Key Similarities with Cascade," Molecular Cell, 52:124-34 (2013)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1058—Hale et al., "RNA-Guided RNA Cleavage by a CRISPR RNACas Protein," Cell, 139(5):945-56 (2009)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1059—Vestergaard et al., "CRISPR adaptive immune systems of Archaea," RNA Biology, 11(2):156-67 (2014)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1060—Voskarides & Deltas, "Screening for Mutations in Kidney-Related Genes Using Surveyor Nuclease for Cleavage at Heteroduplex Mismatches," Journal of Molecular Diagnostics, 11(4):311-18 (2009)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1061—Findlay et al., "A Digital PCR-Based Method for Efficient and Highly Specific Screening of Genome Edited Cells," PLoS One, 11(4):e0153901 (2016)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1062—Kim et al., "Genotyping with CRISPR-Cas-derived RNA-guided endonucleases," Nat Commun, 5:3157 (2014)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1063—Minton, "How can biochemical reactions within cells differ from those in test tubes?," Journal of Cell Science, 119:2863-69 (2006)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1064—Ellis, "Macromolecular crowding: obvious but underappreciated," Trends Biochem Sci, 26(10):597-604 (2001)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1065—Nishimasu et al., "Structural Basis for the Altered PAM Recognition by Engineered CRISPR-Cpf1," Mol Cell, 67(1):139-47 (2017)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1066—Shmakov et al., "Diversity and evolution of class 2 CRISPR-Cas systems," Nat Rev Microbiol., 15(3):169-82 (2017)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1067—Aravind et al., "Holliday junction resolvases and related nucleases: identification of new families, phyletic distribution and evolutionary trajectories," Nucleic Acids Research, 28(18):3417-32 (2000)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1068—Chen et al., "Structural asymmetry in the Thermus thermophilus RuvC dimer suggests a basis for sequential strand cleavages during Holiday junction resolution," Nucleic Acids Research, 41(1):648-59 (2013)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1069—Leenay & Beisel, "Deciphering, communicating, and engineering the CRISPR PAM," J Mol Biol., 429(2):177-91 (2017)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1070—Pul et al., "Identification and characterization of E. coli CRISPR-cas promoters and their silencing by H-NS," Mol Microbiol, 75(6):1495-512 (2010)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1071—Kim et al., "Highly efficient RNA-guided genome editing in human cells via delivery of purified Cas9 ribonucleoproteins," Genome Res., 24(6):1012-9 (2014)—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Jul. 17, 2018.
Exhibit 1072—Transcript of Teleconference with the Board, taken Nov. 27, 2018—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Dec. 4, 2018.
Exhibit 1073—Errata to Transcript of Teleconference with the Board, taken Nov. 27, 2018—*Benson Hill Biosystems, Inc., Petitioner, v. The Broad Institute Inc., Presidents and Fellows of Harvard College & Massachusetts Institute of Technology, Patent Owners,* U.S. Pat. No. 9,790,490, Petition for Post Grant Review, filed Dec. 4, 2018.
Exhibit 2001—Ledford, "Five big mysteries about CRISPR's origins," Nature, 541, 7637, (2017) (last visited Oct. 5, 2018) https://www.nature.com/news/five-big-mysteries-about-crispr-sorigins-1.21294—*Benson Hill Biosystems, Inc., Petitioner, v. The Broad Institute Inc., Presidents and Fellows of Harvard College & Massachusetts Institute of Technology, Patent Owners,* Case PGR2018-00072, U.S. Pat. No. 9,790,490, Patent Owners' Preliminary Response, filed Oct. 24, 2018.
Exhibit 2002—Sapranauskas et al., "The *Streptococcus thermophilus* CRISPR/Cas system provides immunity in *Escherichia coli*," Nucleic Acids Research, 39(21): 9275-9282, (2011)—*Benson Hill Biosystems, Inc., Petitioner, v. The Broad Institute Inc., Presidents and Fellows of Harvard College & Massachusetts Institute of Technology, Patent Owners,* Case PGR2018-00072, U.S. Pat. No. 9,790,490, Patent Owners' Preliminary Response, filed Oct. 24, 2018.
Exhibit 2003—Gasiunas et al., "Cas9-crRNA ribonucleoprotein complex mediates specific DNA cleavage for adaptive immunity in bacteria," PNAS, 10.1073, (2012)—*Benson Hill Biosystems, Inc., Petitioner, v. The Broad Institute Inc., Presidents and Fellows of Harvard College & Massachusetts Institute of Technology, Patent Owners,* Case PGR2018-00072, U.S. Pat. No. 9,790,490, Patent Owners' Preliminary Response, filed Oct. 24, 2018.
Exhibit 2004—Marraffini and Sontheimer, "CRISPR interference limits horizontal gene transfer in staphylococci by targeting DNA," Science, 322(5909): 1843-1845, (2008) (Author Manuscript—supplementary material available on-line)—*Benson Hill Biosystems, Inc., Petitioner, v. The Broad Institute Inc., Presidents and Fellows of Harvard College & Massachusetts Institute of Technology, Patent Owners,* Case PGR2018-00072, U.S. Pat. No. 9,790,490, Patent Owners' Preliminary Response, filed Oct. 24, 2018.
Exhibit 2005—Sinkunas et al., "In vitro reconstruction of cascade-mediated CRISPR immunity in *Streptococcus thermophilus*," The EMBO J, 32, 385-394 (2013) (Supplementary material available

(56) References Cited

OTHER PUBLICATIONS on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2006—Jackson, et al., "Crystal structure of the CRISPR RNA-guided surveillance complex from *Escherichia coli*\*," Science, 345(6203): 1473-1479 (2014) (Author Manuscript—supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2007—Mulepati et al., "Crystal structure of a CRISPR RNA-guided surveillance complex bound to a ssDNA target," Science, 345(6203): 1479-1484, (2014) (Author Manuscript—supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2008—Thabet et al., "Evolutionary trends of the transposase-encoding open reading frames A and B (orfA and orfB) of the mycobacterial IS6110 Insertion sequence," PLOS One, 10(6): 1-5, (2015) (Supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2009—Cong et al., "Multiple genome engineering using CRISPR/Cas system," Science, 339(6121): 819-823 (2013) (Author Manuscript—supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2010—Mali et al., "Cas9 transcriptional activators for target specificity screening and paired nickases for cooperative genome engineering," Nat Biotechnol, 31(9): 833-838, (2013) (Author Manuscript—supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2011—Pennisi, "The CRISPR craze," Science, 15-17, (2013)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2012—Qi et al., "Repurposing CRISPR as an RNA-guided platform for sequence-specific control of gene expression," Cell 152, 1173-1183, (2013) (Supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2013—Gilbert et al., "CRISPR-Mediated modular RNA-guided regulation of transcription in Eukaryotes," Cell 154, 442-451, (2013) (Supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2014—Wu et al., "Target specificity of the CRISPR-Cas9 system," Quant Biol, 2(2): 59-70, (2014) (Author Manuscript—supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2015—Doudna et al., "The new frontier of genome engineering with CRISPR-Cas9," Science, 346(6213), 1077-1086 (2014)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2016—O'Geen et al., "How specific is CRISPR/Cas9 really?" Current Opinion in Chemical Biology, 29: 72-78-, (2015)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2017—Chen et al., "Engineering human stem cell lines with inducible gene knockout using CRISPR/Cas9," Cell Stem Cell 17, 233-244 (2015) (Supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2018—Dow et al., "Inducible in vivo genome editing with CRISPR/Cas9," Nat Biotechnol, 33(4): 390-394, (2015) (Author Manuscript—supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2019—Didovyk et al., "Transcriptional regulation with CRISPR-Cas9: principles, advances and applications," Curr Opin Biotechnol, 40: 177-184, (2016) (Author Manuscript).

Exhibit 2020—Guilinger et al., "Fusion of catalytically inactive Cas9 to FokI nuclease improves the specificity of genome modification," Nat Biotechnol, 32(6): 577-582, (2014) (Author Manuscript—supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2021—Horvath et al., "CRISPR/Cas, the immune system of bacteria and archaea," Science 327, 167-170, (2010)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2022—Maggio et al., "Adenoviral vector delivery of RNA-guided CRISPR/Cas9 nuclease complexes induces targeted mutagenesis in a diverse array of human cells," Scientific Reports, 4: 5105, 1-11, (2014) (Supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

Exhibit 2023—Kwon et al., "Locus-specific histone deacetylation using a synthetic CRISPR-Cas9-based HDAC," NComms 15315, 1-8 (2017) (Supplementary material available on-line)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.

(56) References Cited

OTHER PUBLICATIONS

Exhibit 2024—U.S. Patent Application Publication No. 20180148735 (published May 31, 2018) (Benson Hill Biosystems, Inc., applicant)—*Benson Hill Biosystems, Inc.*, Petitioner, v. *The Broad Institute Inc., Presidents and Fellows of Harvard College & Massachusetts Institute of Technology*, Patent Owners, Case PGR2018-00072, U.S. Pat. No. 9,790,490, Patent Owners' Preliminary Response, filed Oct. 24, 2018.
Flatman, "Magnesium Transport across Cell Membranes", Journal of Membrane Biology, 80, 1984, pp. 1-14.
Gao, et al. "Engineered Cpf1 Enzymes with Altered PAM Specificities", BioRxiv Preprint, XP-002769442, 2016, doi:http://dx.doi.org/10.1101/091611, 1-13, including Figure Legends.
Gao, et al. "Engineered Cpf1 variants with altered PAM specificities", Nature Biotechnology, 2017, 1-4, doi:10.1038/nbt.3900, advanced online publication including Supplementary Information.
Guilinger et al., "Fusion of catalytically inactive Cas9 to FokI nuclease improves the specificity of genome modification", Nature Biotechnology, Jun. 2014, vol. 32, No. 6, pp. 577-581.
Haft, D.H., "HMM Summary Page: TIGR04330", 2012, XP-002757584, http://jcvi.org/cgi-bin/tigrfams/HmmReportPage.cgi?acc=TIGR04330.
Kleinstiver, et al. "Engineered CRISPR-Cas9 nucleases with altered PAM specificities," Nature, vol. 523, pp. 481-485, including Research Letter, dated 2015.
Leenay, et al. "Identifying and Visualizing Functional PAM Diversity across CRISPR-Cas Systems", Molecular Cell, 2016, 62:137-147.
Makarova, et al. "An updated evolutionary classification of CRISPR-Cas systems" Nature Reviews-Microbiology, 2015, 13:722-736.
Mali et al., "CAS9 transcriptional activators for target specificity screening and paired nickases for cooperative genome engineering", Nature Biotechnology, Sep. 2013, vol. 31, No. 9, pp. 833-837.
Naito et al., "CRISPRdirect: Software for designing CRISPR/Cas guide RNA with reduced off-target sites", Bioinformatics, 2015, vol. 31, No. 7, pp. 1120-1123.
Pattanayak et al., "High-throughput profiling of off-target DNA cleavage reveals RNA-programmed Cas9 nuclease specificity", Nature Biotechnology, Sep. 2013, vol. 31, No. 9, pp. 839-845.
Ran et al., "Double Nicking by RNA-guided CRISPR Cas9 for enhanced genome editing specificity", Cell, Sep. 2013, vol. 154, pp. 1380-1389.
Schunder et al., "First indication for a functional CRISPR/Cas system in Francisella tularensis", International Journal of Medical Microbiology, 2013, vol. 303, pp. 51-60.
Shmakov et al., "Discovery and Functional Characterization of Diverse Class 2 CRISPR-Cas Systems", Molecular Cell, vol. 60, No. 3, Oct. 22, 2015. pp.385-397, XP055267512, US.
Type V CRISPR-associated protein Cpfi [*Acidaminococcus* sp. Bv3L6], 2017, NCBI Reference Sequence: WP_02173622.1, Non-redundant Protein Sequence.
Van Der Oost et al., "Unravelling the structural and mechanistic basis of CRISPR-Cas systems", Nature Reviews, Microbiology, Jul. 2014, vol. 12, pp. 479-492.
Van Der Oost, "New tool for genome surgery", Science, Feb. 2013, vol. 339, pp. 768-770.
Vestergaard et al., "CRISPR adaptive immune systems of Archaea", RNA Biology, 2014, vol. 11, No. 2, pp. 156-167.
Wiedenfeft et al., "Structural Basis for DNase Activity of a Conserved Protein Implicated in CRISPR-Mediated Genome Defense", Structure, 17, 2009, pp. 904-912.
Gao, L., et al., Engineered Cpf1 enzymes with altered PAM specificities. bioRxiv preprint doi: https://doi.org/10.1101/091611, Dec. 4, 2016, pp. 1/14-14/14, pp. 1/3-3/3 of Figs, and pp. S1-S8.
Gen Bank Accession No. WP _051666128.1, publicly available Aug. 16, 2015, printed as p. 1/1.
Bikard et al., "Programmable repression and activation of bacterial gene expression using an engineered CRISPR-Cas system," Nucleic Acids Research, 2013, vol. 41, No. 15 (pp. 7429-7437).
Cai et al., "Targeted transgene integration in plant cells using designed zinc finger nucleases," Plant Molecular Biology, 2009, vol. 69 (pp. 699-709).
Gen Bank Accession No. A0Q7Q2.1, RecName: Full=CRISPR-associated endonuclease Cpf1; AltName: Full=FnCpf1, publicly available Dec. 2015, printed as pp. 1/2-2/2. (Year: 2015).
Gen Bank Accession No. U2UMQ6.1, Rec Name: Full=CRISPR-associated endonuclease Cpf1; AltName: Full=AsCpf1, publicly available Dec. 2015, printed as pp. 1/2-2/2. (Year: 2015).
Lee et al., "Site-specific integration in CHO cells mediated by CRISPR/Cas9 and homology-directed DNA repair pathway," Scientific Reports, Feb. 25, 2015, vol. 5 (pp. 1-11).
Leinonen et al., "The EMBL sequence version archive," Bioinformatics, 2003 vol. 19, No. 14 (pp. 1861-1862).
Qi et al., "Repurposing CRISPR as an RNA-Guided Platform for Sequence-Specific Control of Gene Expression," Cell, Feb. 28, 2013, vol. 152 (pp. 1173-1183).
Wang et al., "Delivery of CRISPR/Cas9 by Novel Strategies for Gene Therapy," ChemBioChem,2019 vol. 20 (pp. 634-643).
Wu et al., "Correction of a Genetic Disease in Mouse via Use of CRISPR-Cas9," Cell Stem Cell, Brief Report, vol. 13, Dec. 5, 2013, pp. 659-662.
Yamano et al., "Crystal Structure of Cpf1 in Complex with Guide RNA and Target DNA," Cell, vol. 165, May 5, 2016 (pp. 949-962).
Zhu et al., "A CRISPR/Cas-Mediated Selection-free Knockin Strategy in Human Embryonic Stem Cells," Stem Cell Reports, Jun. 9, 2015, vol. 4, (pp. 1103-1111).
U.S. Appl. No. 14/975,085, filed Dec. 18, 2015.
U.S. Appl. No. 15/783,770, filed Oct. 13, 2017.
U.S. Appl. No. 15/844,608, filed Dec. 17, 2017.
U.S. Appl. No. 16/048,038, filed Jul. 27, 2018.
U.S. Appl. No. 16/071,896, filed Jul. 20, 2018.
U.S. Appl. No. 16/095,170, filed Oct. 19, 2018.
U.S. Appl. No. 16/095,207, filed Oct. 19, 2018.
U.S. Appl. No. 16/095,253, filed Oct. 19, 2018.
U.S. Appl. No. 16/400,026, filed Apr. 30, 2019.
U.S. Appl. No. 16/909,064, filed Jun. 23, 2020.
U.S. Appl. No. 16/909,101, filed Jun. 23, 2020.
U.S. Appl. No. 17/034,553, filed Sep. 28, 2020.
U.S. Appl. No. 17/554,314, filed Dec. 17, 2021.
U.S. Appl. No. 17/554,333, filed Dec. 17, 2021.
U.S. Appl. No. 17/666,248, filed Dec. 7, 2022.
Pougach, K.S., et al., "CRISPR Adaptive Immunity Systems of Prokaryotes," Molecular Biology, 2012, vol. 46 (pp. 175-182).
Doudna et al., "The new frontier of genome engineering with CRISPR-Cas9," Science, Nov. 28, 2014, vol. 346 (pp. 1077-1087).
Rohmer et al., Gen Bank accession No. AOQ7Q2, Dec. 9, 2015 (3 pages).
Singh et al., "Protein Engineering Approaches in the Post-Genomic Era," Current Protein and Peptide Science, 2018, vol. 19, No. 1 (pp. 5-15).
Calero-Garcia et al., "Gene-ectomy: Gene Ablation with CRISPR/Cas9 in Human Hematopoietic Cells," Cell Stem Cell, Nov. 6, 2014 (2 pages).
Long et al., "Prevention of muscular dystrophy in mice by CRISPR/Cas9 mediated editing of germline DNA," Science, Sep. 5, 2014, vol. 345, No. 6201 (pp. 1184-1188).

* cited by examiner

```
33. WP_020988726 (modified)  VKGKNSGKVIVDYFA-KFCDDKFT------DLIQK------VNEGYIAVKDLLNTPY--PENEKIGSNK----
34. WP_016301126 (modified)  QDEKRVKIREAYFAEFKSKDDAK----KQFDLIER------------IILAYAIVEPLLGAEY--PRDRNIIKADE----
35. WP_044919442 (modified)  ---SGNFCNIEGYFERRILE------------IBDK------MRYAYISCKILMDKGL--INNISDQDK----
36. WP_035798880 (modified)  ----SCNLIENYIEQIS---------DDIEN------IIINNITFLRIVINFH--DRSRKIAHNR----
37. WP_029202018 (modified)  ----DISPIENYIERIS---------EDIEK------ICIYNGFFEKIVVNEH--DSSRKESKNI----
38. WP_028248456 (modified)  ----DTTIBEKYIRRLV---------DDIEK------IYTSNNVFSDIVLSKH--DKSKKISKNY----
39. WP_027216152 (modified)  ----NSDVIGKYIEKLE---------SDIETA-----IAEAKNDFDEIVLRKH--DKNKSIKKNT----
40. WP_027109509 (modified)  ----DVDVIGKYIEKLE---------SDIDD------IRFKGKNFYEAVLCGH--DRSKKISKNK----
41. WP_035635841 (modified)  ----INVIDKYIERIN----------EDIKE------ICEAYKEMTKNCFEDH--DKTKKLQKNI----
42. KDN25524 (modified)      ----DLSVVEKLKEIII---------QKVDE------IYKVYGSSEKLFDADF--VLEKSIKKND----
43. KDN25524 (modified)      TARHDDESVQAGKLGQYFKHGLAGVDNPIQK-----IHNNHSTIKGFLERERPAGERAIPKIKSGKNP
44. WP_036388671 (modified)  TARHDDESVQAGKLGQYFKHGLAGVDNPIQK-----IHNNHSTIKGFLERERPAGERAIPKIKSGKNP
45. WP_074407524 (modified)  TARHDDESVQAGKLGQYFKHGLAGVDNPIQK-----IHNNHSTIKGFLERERPAGERAIPKIKSGKNP
46. WP_028830240 (modified)  ----CKVLDAD---------------DAAK------IQDKFNLKDYFIQKN---ALDATIPDLD----
47. WP_022097749 (modified)  ----DVSSNIKMRY------------KEBEQ------NYQVCKENFNAYNWKNIKNIK@SE---
48. WP_012739647 (modified)  ----YIDEKE---------RNEFKNSNAKQYIR-----EISNIITDTETAHLEYDEHISIESE---
49. WP_022501477 (modified)  ----YIDEKE---------RNEFKNSNAKQYIR-----EISNIITDTETAHLEYDDHISIESE---
50. WP_037975888 (modified)  PDYFNAPYIDDDDNA-VKAFGGQGVLGYFN-------KMSELLADVSLYTIDYNSDDSIIENK---
51. AIZ56868 (modified)      ----YSEQVSADISSAPSASYFAKFTN----------LIETAAENGRKFSYFAAESKAFRGDD---
52. WP_015504779 (modified)  ----TGN----NDAFNEYISKMRT------------AREKIDAARKEMKFISEK----ISGDE----
53. WP_031492824 (modified)  ----FSDAS--------AEDIGNRAEDICR-------VISETAPFINDLRAVDLDSLNDDGYE---
54. WP_021736722 (modified)  ----TKFSDELS------------CTLMKVASEKLVKVNEGDWPKHEKNNE---
55. WP_005398606 (modified)  ----KELSEAFK-----------QKTSEILSEAHAALDQP--LPTTLKKQL---
56. WP_013282991 (modified)  ----FEEVDVFS------------VLLEKFKMNNIERSEFEAPIYGSP---
57. WP_044910712 (modified)  ----LFTLYRDEEAR---------NYMRIKEAYGTFERDILKSRRGIKGNR---
                              ----VMAAYIAAVEES--------CAEIMRKEKDLRTLLSKEDVKIRGNR---
```

29. CCB70584 (modified)
30. WP_045971446 (modified)
31. WP_039658684 (modified)
32. WP_037385181 (modified)
33. WP_020988726 (modified)
34. WP_016301126 (modified)
35. WP_044919442 (modified)
36. WP_035798880 (modified)
37. WP_029202018 (modified)
38. WP_028248456 (modified)
39. WP_027216152 (modified)
40. WP_027109509 (modified)
41. WP_035635841 (modified)
42. KDN25524 (modified)   IKDKGRQRSDDERLKLYRFILECLKINPKYDKNFEGAIGDIQLFKKDKGREVPISEKDLFDKINGIF
43. KDN25524 (modified)   IKDKGRQRSDDERLKLYRFILECLKINPKYDKKFEGAIGDIQLFKKDKGREVPISEKDLFDKINGIF
44. WP_036388671 (modified)
45. WP_074407524 (modified)
46. WP_028830240 (modified)
47. WP_022097749 (modified)
48. WP_012739647 (modified)
49. WP_022501477 (modified)
50. WP_037975888 (modified)
51. AIZ56868 (modified)
52. WP_015504779 (modified)
53. WP_031492824 (modified)
54. WP_021736722 (modified)
55. WP_005398606 (modified)
56. WP_013282991 (modified)
57. WP_044910712 (modified)

| | | | |
|---|---|---|---|
| 36. WP_035798880 (modified) | ----PNRAKVKETS------------------------------------------- | ----TFSYDIVKD |
| 37. WP_029202018 (modified) | ----QKRSNCKKTS------------------------------------------- | ----TFSYDIVKD |
| 38. WP_028248456 (modified) | ----SKRAVDKPTS------------------------------------------- | ----KFGVDIKKD |
| 39. WP_027216152 (modified) | ----PKRAAQKPTR------------------------------------------- | ----RLDYDIVKD |
| 40. WP_027109509 (modified) | ----TN--SKKKRS------------------------------------------- | ----IFSYDIVKD |
| 41. WP_035635841 (modified) | ----PD--NPKKTT------------------------------------------- | ----TLSVDVYKD |
| 42. KDN25524 (modified) | ----NPDNPKKR-------------------------------------------- | ----QFVYDIIKD |
| 43. KDN25524 (modified) | ----NPDNPKKR-------------------------------------------- | ----QFVYDIKKD |
| 44. WP_036388671 (modified) | ----NPDNPKKR-------------------------------------------- | ----QFVYDIKKD |
| 45. WP_027407524 (modified) | ----NPLNTKKES------------------------------------------- | ----VENYDEKKD |
| 46. WP_028830240 (modified) | ---------------------------------------------------- | ----KFDVPIIKD |
| 47. WP_022097749 (modified) | KNQLDNGDVVRIPIPDDIYNEIYKMYNG-YIKESDLSEAAKEYLDK---VEVRTAQKDIVKD |
| 48. WP_012739647 (modified) | KNQLDNGDVVRIPIPDDIYNEIYKMYNG-YIKESDLSEAAKEYLDK---VEVRTAQKDIVKD |
| 49. WP_022501477 (modified) | INETG----VRVSLSDEDYNKVYNYNNNYVIDTENDKNLIDIIEK----IGHRKSKIDIVKD |
| 50. WP_037975888 (modified) | IDGNP-------IDEGTYVETCGYANGK-RDMASLNAGARGLIESGL----VRITEVKHEVKD |
| 51. AIZ56868 (modified) | NGRTP-------VPDKIHKKLTDYHNGRTKDLG----EAKEYLDK---VRYFKAHVDITKD |
| 52. WP_022097749 (modified) | VNGRR-------IPDSIYRELTRYFNRGDCRIS----DEAKSYLDK---VKTKKADHDIVKD |
| 53. WP_031492824 (modified) | KDG-TSLDDKIRNEIYQYEN-KFIDTLSDEAKKVLPN------------VIKKEATHDITKD |
| 54. WP_021736722 (modified) | KDQKTPIPDTLYQELYDYVNHRLSHDLSDEARALLPN------------VITKEVSHEKKD |
| 55. WP_005398606 (modified) | KEGNTIPENIYHECYRYLNKKIGREDLSDEAIALFN----KDVLKYKEARFDKKKD |
| 56. WP_013282991 (modified) | SNGEHIPMEIREAIYKMKNNFDISSED--------FIMAKAYLAEHDVAIKKANEDITRN |
| 57. WP_044910712 (modified) | KDGKYIPPEVHDELYRFFNNLLIKEKLGEKARKILDN----KKVKVKVLESIRVKW |

pACYC184 FnCpf1 locus (pY001)

```
5'    gaattccggatgagcattcatcaggcgggcaagaatgtgaataaaggccg
                                                              50
              cat(CmR)

5'    gataaacttgtgcttattttctttacggtctttaaaaggccgtaata
                                                              100
              cat(CmR)

5'    tccagctgaacggtctggttataggtacattgagcaactgactgaaatgc
                                                              150
              cat(CmR)

5'    ctcaaaatgttctttacgatgccattgggatatatcaacggtggtatatc
                                                              200
              cat(CmR)

5'    cagtgatttttttctccattttagcttccttagctcctgaaaatctcgat
                                                              250
        cat(CmR)

5'    aactcaaaaaatacgcccggtagtgatcttatttcattatggtgaaagtt
                                                              300

5'    ggaacctcttacgtgccgatcaacgtctcattttcgccaaaagttggccc
                                                              350

5'    agggcttcccggtatcaacagggacaccaggatttatttattctgcgaag
                                                              400

5'    tgatcttccgtcacaggtatttattcggcgcaaagtgcgtcgggtgatgc
                                                              450

5'    tgccaacttactgatttagtgtatgatggtgttttgaggtgctccagtg
                                                              500

5'    gcttctgtttctatcagctgtccctcctgttcagctactgacggggtggt
                                                              550

5'    gcgtaacggcaaaagcaccgccggacatcagcgctagcggagtgtatact
                                                              600
```

FIG. 3A pACYC184 FnCpf1 locus (pY001)

```
5' ggcttactatgttggcactgatgagggtgtcagtgaagtgcttcatgtgg
                                                        650

5' caggagaaaaaaggctgcaccggtgcgtcagcagaatatgtgatacagga
                                                        700

5' tatattccgcttcctcgctcactgactcgctacgctcggtcgttcgactg
                                                        750

5' cggcgagcggaaatggcttacgaacggggcggagatttcctggaagatgc
                                                        800

5' caggaagatacttaacagggaagtgagagggccgcggcaaagccgttttt
                                                        850
                                                    [o...]

5' ccataggctccgccccctgacaagcatcacgaaatctgacgctcaaatc
                                                        900
         [ origin ]

5' agtggtggcgaaacccgacaggactataaagataccaggcgtttccccct
                                                        950
         [ origin ]

5' ggcggctccctcgtgcgctctcctgttcctgcctttcggtttaccggtgt
                                                        1000
         [ origin ]

5' cattccgctgttatggccgcgtttgtctcattccacgcctgacactcagt
                                                        1050
         [ origin ]

5' tccgggtaggcagttcgctccaagctggactgtatgcacgaaccccccgt
                                                        1100
         [ origin ]

5' tcagtccgaccgctgcgccttatccggtaactatcgtcttgagtccaacc
                                                        1150
         [ origin ]
```

FIG. 3B pACYC184 FnCpf1 locus (pY001)

```
5'   cggaaagacatgcaaaagcaccactggcagcagccactggtaattgattt
                                                              1200
                            origin 5'   agaggagttagtcttgaagtcatgcgccggttaaggctaaactgaaagga
                                                              1250
                            origin 5'   caagttttggtgactgcgctcctccaagccagttacctcggttcaaagag
                                                              1300
                            origin 5'   ttggtagctcagagaaccttcgaaaaaccgccctgcaaggcggttttttc
                                                              1350
                            origin
                                          GCCCTGCAAGGCGGTTTTTT
                                                  nC0008

5'   gttttcagagcaagagattacgcgcagaccaaaacgatctcaagaagatc
                                                              1400
                            origin 5'   atcttattaatcagataaatatttcatcaaggaattggttctaagctta
                                                              1450
                              CATCAAGGAATTG...AGCTTATAGAAGC
                                      acetyltransferase 5'   tagaagcaatgattaaggaagccaaaaaaataatattgatgcaatattt
                                                              1500
     CAT...AGC                             TGATGC...TCCAAG
                            acetyltransferase 5'   gtcttaggtcatccaagttattatccaaaatttggttttaaaccagccac
                                                              1550
     TGATGCAAT...CATCCAAG                   AACCA...TGTG
                            acetyltransferase
```

FIG. 3C pACYC184 FnCpf1 locus (pY001)

```
5'   agaatatcagataaaatgtgaatatgatgtcccagcggatgttttatgg
                                                              1600
     AACCAGCCAC...ATAAAATGTG>
     ─────────────acetyltransferase─────────────

5'   tactagatttgtcagctaaactagctagtttaaaaggacaaactgtctac
                                                              1650
     ─────────────acetyltransferase─────────────

5'   tatgccgatgagtttggcaaaattttttagatctacaaattataaacta
                                                              1700
                                       Geneious type: motif ────acetyltransferase────>

5'   aataaagattcttataataactttatatataatcgaaatgtagagaattt
                                                              1750
     Geneious type: motif Ge...h 5'   tataaggagtctttatcatgtcaatttatcaagaatttgttaataaatat
                                                              1800
                              ──hypothetical protein──
     ATGTCAATTTATCAAGAAT...AAATATAGTTTAAGTAAA 5'   agtttaagtaaaactctaagatttgagttaatcccacagggtaaaacact
                                                              1850
     ──hypothetical protein──
     ATGTCA...GTAAA>
```

FIG. 3D pACYC184 FnCpf1 locus (pY001)

```
5'    tgaaaacataaaagcaagaggtttgattttagatgatgagaaaagagcta
                            hypothetical protein                          1900

5'    aagactacaaaaaggctaaacaaataattgataaatatcatcagttttttt
                            hypothetical protein                          1950

5'    atagaggagatattaagttcggtttgtattagcgaagatttattacaaaa
                            hypothetical protein                          2000
```

```
      AGGAGATATTAAGTTCGGTTTGTATTAGCGAAG >
            SFnCpf001 For              >
      < TCCTCTATAATTCAAGCCAAACATAATCGCT
            < SFnCpf010
```

```
5'    ctattctgatgtttatttttaaacttaaaaagagtgatgatgataatctac
                            hypothetical protein                          2050

5'    aaaaagattttaaaagtgcaaaagatacgataaagaaacaaatatctgaa
                            hypothetical protein                          2100

5'    tatataaaggactcagagaaatttaagaatttgtttaatcaaaaccttat
                            hypothetical protein                          2150

5'    cgatgctaaaaaagggcaagagtcagatttaattctatggctaaagcaat
                            hypothetical protein                          2200

5'    ctaaggataatggtatagaactatttaaagccaatagtgatatcacagat
                            hypothetical protein                          2250
```

FIG. 3E pACYC184 FnCpf1 locus (pY001)

```
5'   atagatgaggcgttagaaataatcaaatcttttaaaggttggacaactta
                                                              2300
                          hypothetical protein 5'   ttttaagggttttcatgaaaatagaaaaatgtttatagtagcaatgata
                                                              2350
                          hypothetical protein 5'   ttcctacatctattatttataggatagtagatgataatttgcctaaattt
                                                              2400
                          hypothetical protein 5'   ctagaaaataaagctaagtatgagagtttaaaagacaaagctccagaagc
                                                              2450
                          hypothetical protein 5'   tataaactatgaacaaattaaaaaagatttggcagaagagctaaccttg
                                                              2500
                          hypothetical protein 5'   atattgactacaaaacatctgaagttaatcaaagagttttttcacttgat
                                                              2550
                          hypothetical protein 5'   gaagttttgagatagcaaactttaataattatctaaatcaaagtggtat
                                                              2600
                          hypothetical protein 5'   tactaaatttaatactattattggtggtaaatttgtaaatggtgaaaata
                                                              2650
                          hypothetical protein
              ┌─────────────────────────────────────────┐
              │ TAATACTATTATTGGTGGTAAATTTGTAAATGGTG     ▶
              │ SFnCpf002 For                           │
              └─────────────────────────────────────────┘

5'   caaagagaaaaggtataaatgaatatataaatctatactcacagcaaata
                                                              2700
                          hypothetical protein
```

FIG. 3F pACYC184 FnCpf1 locus (pY001)

```
5'   aatgataaaacactcaaaaaatataaaatgagtgttttatttaagcaaat
                          hypothetical protein                    2750

5'   tttaagtgatacagaatctaaatcttttgtaattgataagttagaagatg
                          hypothetical protein                    2800

5'   atagtgatgtagttacaacgatgcaaagttttatgagcaaatagcagct
                          hypothetical protein                    2850

5'   tttaaaacagtagaagaaaaatctattaaagaaacactatctttattatt
                          hypothetical protein                    2900

5'   tgatgatttaaaagctcaaaaacttgatttgagtaaaatttatttaaaa
                          hypothetical protein                    2950

5'   atgataaatctcttactgatctatcacaacaagttttgatgattatagt
                          hypothetical protein                    3000

5'   gttattggtacagcggtactagaatatataactcaacaaatagcacctaa
                          hypothetical protein                    3050

5'   aaatcttgataaccctagtaagaagagcaagaattaatagccaaaaaa
                          hypothetical protein                    3100

5'   ctgaaaaagcaaaatacttatctctagaaactataaagcttgccttagaa
                          hypothetical protein                    3150
```

FIG. 3G

```
pACYC184 FnCpf1 locus (pY001)
5'  gaatttaataagcatagagatatagataaacagtgtaggtttgaagaaat
                                                              3200
              hypothetical protein 5'  acttgcaaactttgcggctattccgatgatatttgatgaaatagctcaaa
                                                              3250
              hypothetical protein 5'  acaaagacaatttggcacagatatctatcaaatatcaaaatcaaggtaaa
                                                              3300
              hypothetical protein 5'  aaagacctacttcaagctagtgcggaagatgatgttaaagctatcaagga
                                                              3350
              hypothetical protein 5'  tcttttagatcaaactaataatctcttacataaactaaaaatatttcata
                                                              3400
              hypothetical protein 5'  ttagtcagtcagaagataaggcaaatattttagacaaggatgagcatttt
                                                              3450
              hypothetical protein 5'  tatctagtatttgaggagtgctactttgagctagcgaatatagtgcctct
                                                              3500
              hypothetical protein
            TGAGGAGTGCTACTTTGAGCTAGCGA 5'  ttataacaaaattagaaactatataactcaaaagccatatagtgatgaga
                                                              3550
              hypothetical protein 5'  aatttaagctcaattttgagaactcgactttggctaatggttgggataaa
                                                              3600
              hypothetical protein
```

FIG. 3H pACYC184 FnCpf1 locus (pY001)

```
5'    aataaagagcctgacaatacggcaattttatttatcaaagatgataaata
                                                                    3650
          —————————————— hypothetical protein ——————————————

5'    ttatctgggtgtgatgaataagaaaaataacaaatatttgatgataaag
                                                                    3700
          —————————————— hypothetical protein ——————————————

5'    ctatcaaagaaaataaaggcgagggttataaaaaattgtttataaactt
                                                                    3750
          —————————————— hypothetical protein ——————————————

5'    ttacctggcgcaaataaaatgttacctaaggttttcttttctgctaaatc
                                                                    3800
          —————————————— hypothetical protein ——————————————
                              ⟨GATTCCAAAAGAAA...TTTAAAATATTAG⟩

5'    tataaaattttataatcctagtgaagatatacttagaataagaaatcatt
                                                                    3850
          —————————————— hypothetical protein ——————————————
                       ⟨ACTTCTATATGAATCTT...TTAGTAAGGTGTGTAT⟩
                       | TGAAGATATACTTAGA...AATCATTCCACACATA |
      | GATTCCAAA...AATATTAG |

5'    ccacacatacaaaaaatggtagtcctcaaaaaggatatgaaaaatttgag
                                                                    3900
          —————————————— hypothetical protein ——————————————

| ACTT...GTAT |
      ⟨ TGAA...CATA ⟩

5'    tttaatattgaagattgccgaaaatttatagatttttataaacagtctat
                                                                    3950
          —————————————— hypothetical protein ——————————————

5'    aagtaagcatccggagtggaaagattttggatttagattttctgatactc
                                                                    4000
          —————————————— hypothetical protein ——————————————
```

FIG. 3I pACYC184 FnCpf1 locus (pY001)

```
5'    aaagatataattctatagatgaattttatagagaagttgaaaatcaaggc
              hypothetical protein                        4050

5'    tacaaactaacttttgaaaatatatcagagagctatattgatagcgtagt
              hypothetical protein                        4100

5'    taatcagggtaaattgtacctattccaaatctataataaagattttcag
              hypothetical protein                        4150

5'    cttatagcaaagggcgaccaaatctacatactttatattggaaagcgctg
              hypothetical protein                        4200

5'    tttgatgagagaaatcttcaagatgtggtttataagctaaatggtgaggc
              hypothetical protein                        4250
                                              GGT...AAA 5'    agagcttttttatcgtaaacaatcaatacctaaaaaatcactcacccag
              hypothetical protein                        4300
      GGTGAGGCAG...TATCGTAAA 5'    ctaaagaggcaatagctaataaaaacaaagataatcctaaaaagagagt
              hypothetical protein                        4350

5'    gttttgaatatgatttaatcaaagataaacgctttactgaagataagtt
              hypothetical protein                        4400

5'    tttctttcactgtcctattacaatcaattttaaatctagtggagctaata
              hypothetical protein                        4450
```

FIG. 3J pACYC184 FnCpf1 locus (pY001)

```
5'  agtttaatgatgaaatcaatttattgctaaaagaaaaagcaaatgatgtt  4500
                        hypothetical protein 5'  catatattaagtatagatagaggtgaaagacatttagcttactatactttt  4550
                        hypothetical protein 5'  ggtagatggtaaaggcaatatcatcaaacaagatactttcaacatcattg  4600
                        hypothetical protein 5'  gtaatgatagaatgaaaacaaactaccatgataagcttgctgcaatagag  4650
                        hypothetical protein 5'  aaagatagggattcagctaggaaagactggaaaaagataaataacatcaa  4700
                        hypothetical protein 5'  agagatgaaagagggctatctatctcaggtagttcatgaaatagctaagc  4750
                        hypothetical protein 5'  tagttatagagtataatgctattgtggtttttgaggatttaaattttgga  4800
                        hypothetical protein 5'  tttaaaagagggcgtttcaaggtagagaagcaggtctatcaaaagttaga  4850
                        hypothetical protein 5'  aaaaatgctaattgagaaactaaactatctagttttcaaagataatgagt  4900
                        hypothetical protein
```

FIG. 3K pACYC184 FnCpf1 locus (pY001)

```
5'   ttgataaaactgggggagtgcttagagcttatcagctaacagcaccttt t
                                                         4950
                   hypothetical protein
          CTGGGGGAGTGCTTAGAGCTTATCAG 5'   gagacttttaaaaagatgggtaaacaaacaggtattatctactatgtac c
                                                         5000
                   hypothetical protein 5'   agctggttttacttcaaaaatttgtcctgtaactggttttgtaaatcag t
                                                         5050
                   hypothetical protein 5'   tatatcctaagtatgaaagtgtcagcaaatctcaagagttctttagtaa g
                                                         5100
                   hypothetical protein 5'   tttgacaagatttgttataaccttgataagggctattttgagtttagtt t
                                                         5150
                   hypothetical protein 5'   tgattataaaaactttggtgacaaggctgccaaaggcaagtggactata g
                                                         5200
                   hypothetical protein 5'   ctagctttgggagtagattgattaactttagaaattcagataaaaatca t
                                                         5250
                   hypothetical protein 5'   aattgggatactcgagaagtttatccaactaaagagttggagaaattgc t
                                                         5300
                   hypothetical protein 5'   aaaagattattctatcgaatatgggcatggcgaatgtatcaaagcagct a
                                                         5350
                   hypothetical protein
```

FIG. 3L pACYC184 FnCpf1 locus (pY001)

```
5'    tttgcggtgagagcgacaaaaagttttttgctaagctaactagtgtccta
                         — hypothetical protein —                              5400

5'    aatactatcttacaaatgcgtaactcaaaaacaggtactgagttagatta
                         — hypothetical protein —                              5450

5'    tctaatttcaccagtagcagatgtaaatggcaatttctttgattcgcgac
                         — hypothetical protein —                              5500

5'    aggcgccaaaaatatgcctcaagatgctgatgccaatggtgcttatcat
                         — hypothetical protein —                              5550
                                            [ TGCCAATGGT...TCATATTGGG ]

5'    attgggctaaaaggtctgatgctactaggtaggatcaaaaataatcaaga
                         — hypothetical protein —                              5600
      < TG...GG |

5'    gggcaaaaaactcaatttggttatcaaaaatgaagagtattttgagttcg
                         — hypothetical protein —                              5650
                                            < CATAAAA...ATTGATT |

5'    tgcagaataggaataactaattcattcaagaatatattaccctgtcagtt
      — hypothetical protein —                                                 5700
      | CATAAAACTCA...CTTATTGATT >

5'    tagcgactattacctctttaataatttgcaggggaattattttagtaata
                                                                               5750

5'    gtaatatacacaagagttattgattatatggaaaattatatttagataac
                                                                               5800
```

FIG. 3M pACYC184 FnCpf1 locus (pY001)

```
5'    atggttaaatgattttatattctgtccttactcgatatatttgcataata
                                                              5850
                                            ─endonuclease─

5'    tctatagtaatgcctcagatactacatactattcatctagccaaacaaaa
                                                              5900
      ──────────────────── endonuclease ────────────────────

5'    gggcgcgatgctcataaaagtatcgataaggaatctatagtaccaaaaa
                                                              5950
      ──────────────────── endonuclease ────────────────────

5'    agatgacctgatcggtatcgatgttattaaccataaatatggtttggttg
                                                              6000
      ──────────────────── endonuclease ────────────────────

5'    gtaaaattgatgttttcataaagataagggcttacttgtggagagaaaa
                                                              6050
      ──────────────────── endonuclease ────────────────────

5'    aggcaaatcaagactatctatgatggctataaatatcagctttatgcgca
                                                              6100
      ──────────────────── endonuclease ────────────────────

5'    atattttgtctccaagagatgggctatgatgtcaaagccattaaatttt
                                                              6150
      ──────────────────── endonuclease ────────────────────

ATTTTTGTCTCCAAGAGATGGGCTATGA >
       < TAAAAACAGAGGTTCTCTACCCGATACT

5'    attcgatggttgataataaatcatacccaatagctataccaacttcagct
                                                              6200
      ──────────────────── endonuclease ────────────────────

5'    gagttagaaaagtttgaaaaacatattcaaacaatcaagcaatataatcc
                                                              6250
      ──────────────────── endonuclease ────────────────────
```

FIG. 3N pACYC184 FnCpf1 locus (pY001)

```
5'   aatggataactcatttaggcaaaatattgaaaagtgtaaattttgtatat
                                                          6300
                         endonuclease 5'   atgcaaacttatgtgataaaacggacttgtagattatgtttagtaaaaat
                                                          6350
              endonuclease                 CRISPR-ass...tein Cas1

5'   gatattgaatcaaagaatatagttttgttaatattttgatggagtgaa
                                                          6400
                     CRISPR-associated protein Cas1

5'   acttagtctatcattggggaatatagttataaaagataaagaaactgatg
                                                          6450
                     CRISPR-associated protein Cas1

5'   aggtgaaaactaagctttctgttcataaagttcttgcattgtttatcgta
                                                          6500
                     CRISPR-associated protein Cas1

5'   ggtaatatgacgatgacctcgcaacttttagagacctgtaagaaaatgc
                                                          6550
                     CRISPR-associated protein Cas1

5'   tatacagctagttttatgaaaatagctttagaccatatctatgttttg
                                                          6600
                     CRISPR-associated protein Cas1

5'   gtgatattgctgaggctaattttttagctagatataagcaatatagtgta
                                                          6650
                     CRISPR-associated protein Cas1

5'   gttgagcaagatataagtttagcaaggattttataacatcaaagatacg
                                                          6700
                     CRISPR-associated protein Cas1
```

FIG. 3O pACYC184 FnCpf1 locus (pY001)

```
5'  caatcaacataacttagtcaaaagcctaagagataaaactccagagcagc
                                                          6750
                    CRISPR-associated protein Cas1

5'  aagagatagtcaaaaagaataaacagctaatagcagagttagaaaataca
                                                          6800
                    CRISPR-associated protein Cas1

5'  acaagcctagcggagctaatgggtatagagggcaatgttgccaaaaattt
                                                          6850
                    CRISPR-associated protein Cas1

5'  cttcaaaggattctatggacatttagatagttggcaagggcgcaaaccta
                                                          6900
                    CRISPR-associated protein Cas1
                                        GGCAAGGGC ACCTAGAA 5'  gaataaaacaggatccatataatgttgttttagacttgggctatagtatg
                                                          6950
                    CRISPR-associated protein Cas1

5'  ttgtttaattttgtagagtgttttttgcgacttttggctttgatttata
                                                          7000
                    CRISPR-associated protein Cas1

5'  caagggcttttgtcatcagacttggtataagcgtaaatccctagtttgtg
                                                          7050
                    CRISPR-associated protein Cas1

5'  actttgttgagccatttagatgtatagtggataaccaagttagaaaatca
                                                          7100
                    CRISPR-associated protein Cas1

5'  tggaatctcgggcaattttctgtagaggattttggttgcaaaatgagca
                                                          7150
                    CRISPR-associated protein Cas1
```

FIG. 3P pACYC184 FnCpf1 locus (pY001)

```
5'   gttttatataaaaaaagataaaacaaaagactactcaaaaatacttttg
                                                          7200
     CRISPR-associated protein Cas1

5'   ccgagattatcagctacaagctagagatatttgaatatgtaagagaattt
                                                          7250
     CRISPR-associated protein Cas1

5'   tatcgtgcctttatgcgaggcaaagaaattgcagagtatccaatattttg
                                                          7300
     CRISPR-associated protein Cas1

5'   ttatgaaactaggagggtgtatgttgatagtcagttatgatttagtaat
                                                          7350
     CRISPR-associated protein Cas1
                             CRISPR-associated endonuclease Cas2

5'   aataaagtacgtgcaaagtttgccaaatttctagaaagttatggtgtacg
                                                          7400
     CRISPR-associated endonuclease Cas2

5'   tttacaatattcggtatttgagctcaaatatagcaagagaatgttagact
                                                          7450
     CRISPR-associated endonuclease Cas2

5'   tgatttagctgagatagaaaataactatgtaccactatttacaaatgct
                                                          7500
     CRISPR-associated endonuclease Cas2

5'   gatagtgttttaatctttaatgctccagataaagatgtgataaaatatgg
                                                          7550
     CRISPR-associated endonuclease Cas2
```

FIG. 3Q pACYC184 FnCpf1 locus (pY001)

```
5'    ttatgcgattcatagagaacaagaggttgtttttatagactaaaaattgc
                                                              7600
           CRISPR-associated endonuclease Cas2

GGTTATGCGATTCATAGAGAACAAGAGGT

5'    aaaccttagtctttatgttaaaataactactaagttcttagagatattta
                                                              7650

5'    aaaatatgactgttgttatatatcaaaatgctaaaaaaatcatagatttt
                                                              7700

5'    aggtctttttttgctgatttaggcaaaaacgggtctaagaactttaaata
                                                              7750
                                           Geneious type: motif
                                           COORDINATES: ...ent:crt:1,2

5'    atttctactgttgtagatgagaagtcatttaataaggccactgttaaaag
                                                              7800
           Geneious type: motif
           COORDINATES: alignment:crt:1,2

5'    tctaagaactttaaataatttctactgttgtagatgctactattcctgtg
                                                              7850
           Geneious type: motif
           COORDINATES: alignment:crt:1,2

5'    ccttcagataattcagtctaagaactttaaataatttctactgttgtaga
                                                              7900
                        Geneious type: motif
                        COORDINATES: alignment:crt:1,2
```

FIG. 3R pACYC184 FnCpf1 locus (pY001)

```
5'   tgtctagagccttttgtattagtagccggtctaagaactttaaataattt
                                                              7950
                                        Geneious type: motif
        COORDINATES: alignment:crt:1.2

5'   ctactgttgtagattagcgatttatgaaggtcattttttgtctagcttt
                                                              8000
     Geneious type: motif    TCGCTAAATACTTCCAGTAAAAAACAGA
        COORDINATES: alignment:crt:1.2
                                                      Ge...if 5'   aatgcggtagtttatcacagttaaattgctaacgcagtcaggcaccgtgt
                                                              8050
                              TTGCGTCAGT...TGGCACATAC
                                        nC0009

5'   atgaaatctaacaatgcgctcatcgtcatcctcggcaccgtcacctgga
                                                              8100
                              TcR
     T...
     n...

5'   tgctgtaggcataggcttggttatgccggtactgccgggcctcttgcggg
                                                              8150
                              TcR 5'   atatcgtccattccgacagcatcgccagtcactatggcgtgctgctagcg
                                                              8200
                              TcR 5'   ctatatgcgttgatgcaatttctatgcgcacccgttctcggagcactgtc
                                                              8250
                              TcR 5'   cgaccgctttggcccgccgccagtcctgctcgcttccgtacttggagcca
                                                              8300
                              TcR
```

FIG. 3S pACYC184 FnCpf1 locus (pY001)

```
5'   ctatcgactacgcgatcatggcgaccacacccgtcctgtggatcctctac
                                                          8350
                          TcR 5'   gccggacgcatcgtggccggcatcaccggcgccacaggtgcggttgctgg
                                                          8400
                          TcR 5'   cgcctatatcgccgacatcaccgatggggaagatcgggctcgccacttcg
                                                          8450
                          TcR 5'   ggctcatgagcgcttgtttcggcgtgggtatggtggcaggccccgtggcc
                                                          8500
                          TcR 5'   ggggactgttgggcgccatctccttgcatgcaccattccttgcggcggc
                                                          8550
                          TcR 5'   ggtgctcaacggcctcaacctactactgggctgcttcctaatgcaggagt
                                                          8600
                          TcR 5'   cgcataagggagagcgtcgaccgatgcccttgagagccttcaacccagtc
                                                          8650
                          TcR 5'   agctccttccggtgggcgcggggcatgactatcgtcgccgcacttatgac
                                                          8700
                          TcR 5'   tgtcttctttatcatgcaactcgtaggacaggtgccggcagcgctctggg
                                                          8750
                          TcR
```

FIG. 3T pACYC184 FnCpf1 locus (pY001)

```
5'  tcattttcggcgaggaccgctttcgctggagcgcgacgatgatcggctg
                                                        8800
                         TcR 5'  tcgcttgcggtattcggaatcttgcacgcctcgctcaagccttcgtcac
                                                        8850
                         TcR 5'  tggtcccgccaccaaacgtttcggcgagaagcaggccattatcgccggca
                                                        8900
                         TcR 5'  tggcggccgacgcgctgggctacgtcttgctggcgttcgcgacgcgaggc
                                                        8950
                         TcR 5'  tggatggccttccccattatgattcttctcgcttccggcggcatcgggat
                                                        9000
                         TcR 5'  gcccgcgttgcaggccatgctgtccaggcaggtagatgacgaccatcagg
                                                        9050
                         TcR 5'  gacagcttcaaggatcgctcgcggctcttaccagcctaacttcgatcatt
                                                        9100
                         TcR 5'  ggaccgctgatcgtcacggcgatttatgccgcctcggcgagcacatggaa
                                                        9150
                         TcR 5'  cgggttggcatggattgtaggcgccgccctataccttgtctgcctcccg
                                                        9200
                         TcR
```

FIG. 3U pACYC184 FnCpf1 locus (pY001)

```
cggccacggggcctgccaccatacccacgccgaaacaagcgccctgcacc       9900
attatgttccggatctgcatcgcaggatgctgctggctaccctgtggaac       9950
acctacatctgtattaacgaagcgctaaccgttttatcaggctctggga        10000
ggcagaataaatgatcatatcgtcaattattacctccacggggagagcct       10050
gagcaaactggcctcaggcatttgagaagcacacggtcacactgcttccg       10100
gtagtcaataaaccggtaaaccagcaatagacataagcggctatttaacg       10150
accctgccctgaaccgacgaccgggtcgaatttgctttcgaatttctgcc       10200
attcatccgcttattatcacttattcaggcgtagcaccaggcgtttaagg       10250
gcaccaataactgccttaaaaaaattacgccccgccctgccactcatcgc       10300
```
cat(CmR)
```
agtactgttgtaattcattaagcattctgccgacatggaagccatcacag       10350
```
cat(CmR)
```
acggcatgatgaacctgaatcgccagcggcatcagcaccttgtcgccttg       10400
```
cat(CmR)
```
cgtataatatttgcccatggtgaaaacgggggcgaagaagttgtccatat       10450
```
cat(CmR)

FIG. 3W pACYC184 FnCpf1 locus (pY001)

```
5'  tggccacgtttaaatcaaaactggtgaaactcacccagggattggctgag
                                                            10500
         cat(CmR)

5'  acgaaaacatattctcaataaaccctttagggaataggccaggttttc
                                                            10550
         cat(CmR)

5'  accgtaacacgccacatcttgcgaatatatgtgtagaaactgccggaaat
                                                            10600
         cat(CmR)

5'  cgtcgtggtattcactccagagcgatgaaaacgtttcagtttgctcatgg
                                                            10650
         cat(CmR)

5'  aaaacggtgtaacaagggtgaacactatcccatatcaccagctcaccgtc
                                                            10700
         cat(CmR)

5'  tttcattgccatacg
                                                            10715
         cat(CmR)
```

FIG. 3X

```
I -Cpf1- PaCpf1
5' gccaccATGAACATCAAAAACTTTACCGGGCTCTACCCCCTCAGCAAAACTTTGCGCTTT
o        ++++++++++++++++++++++++++++++++++++++++++++++++++++++++++++  60
o
1        A  T  M  N  I  K  N  F  T  G  L  Y  P  L  S  K  T  L  R  F
o
5' GAACTCAAGCCTATTGGCAAAACCAAGGAAAACATCGAGAAAAATGGCATCCTGACCAAG
o        ++++++++++++++++++++++++++++++++++++++++++++++++++++++++++++  120
o
1        E  L  K  P  I  G  K  T  K  E  N  I  E  K  N  G  I  L  T  K
o
5' GACGAGCAACGGGCTAAAGACTACCTCATAGTCAAAGGCTTTATTGACGAGTATCACAAG
o        ++++++++++++++++++++++++++++++++++++++++++++++++++++++++++++  180
o
1        D  E  Q  R  A  K  D  Y  L  I  V  K  G  F  I  D  E  Y  H  K
o
5' CAGTTCATCAAAGACAGGCTTTGGGACTTTAAATTGCCTCTCGAAAGTGAGGGGGAGAAG
o        ++++++++++++++++++++++++++++++++++++++++++++++++++++++++++++  240
o
1        Q  F  I  K  D  R  L  W  D  F  K  L  P  L  E  S  E  G  E  K
o
5' AACAGTCTCGAAGAATACCAGGAACTGTACGAGCTCACTAAGCGCAACGATGCCCAGGAG
o        ++++++++++++++++++++++++++++++++++++++++++++++++++++++++++++  300
o
1        N  S  L  E  E  Y  Q  E  L  Y  E  L  T  K  R  N  D  A  Q  E
o
5' GCCGACTTCACCGAGATTAAAGATAACCTTCGCAGCTCTATTACCGAACAGCTCACGAAG
o        ++++++++++++++++++++++++++++++++++++++++++++++++++++++++++++  360
o
1        A  D  F  T  E  I  K  D  N  L  R  S  S  I  T  E  Q  L  T  K
o
5' TCTGGATCTGCGTACGATCGGATTTTTAAAAAGAGTTCATTAGAGAAGACCTGGTCAAC
o        ++++++++++++++++++++++++++++++++++++++++++++++++++++++++++++  420
o
1        S  G  S  A  Y  D  R  I  F  K  K  E  F  I  R  E  D  L  V  N
o
5' TTCCTCGAAGATGAAAAAGATAAAAATATCGTGAAACAGTTCGAGGACTTTACTACATAT
o        ++++++++++++++++++++++++++++++++++++++++++++++++++++++++++++  480
o
1        F  L  E  D  E  K  D  K  N  I  V  K  Q  F  E  D  F  T  T  Y
o
```

FIG. 4A

```
I - Cpf1 - PaCpf1
5'  TTTACGGGTTTTTATGAAAATAGGAAGAACATGTACTCTAGCGAAGAGAAGTCCACGGCC
                                                                              540
     F  T  G  F  Y  E  N  R  K  N  M  Y  S  S  E  E  K  S  T  A

5'  ATCGCATACCGGCTTATCCATCAGAATCTGCCAAAATTCATGGACAACATGAGAAGTTTT
                                                                              600
     I  A  Y  R  L  I  H  Q  N  L  P  K  F  M  D  N  M  R  S  F

5'  GCCAAAATTGCAAATTCCAGTGTTTCCGAGCACTTTAGCGACATCTATGAAAGCTGGAAG
                                                                              660
     A  K  I  A  N  S  S  V  S  E  H  F  S  D  I  Y  E  S  W  K

5'  GAATATCTGAATGTAAATAGCATCGAGGAAATCTTCCAGCTCGACTATTTTAGCGAAACC
                                                                              720
     E  Y  L  N  V  N  S  I  E  E  I  F  Q  L  D  Y  F  S  E  T

5'  TTGACTCAGCCACATATTGAGGTGTATAACTATATTATCGGGAAGAAAGTCCTGGAAGAC
                                                                              780
     L  T  Q  P  H  I  E  V  Y  N  Y  I  I  G  K  K  V  L  E  D

5'  GGAACCGAGATAAAGGGCATCAACGAGTATGTGAACCTCTACAATCAGCAGCAGAAAGAT
                                                                              840
     G  T  E  I  K  G  I  N  E  Y  V  N  L  Y  N  Q  Q  K  D

5'  AAGAGTAAACGACTGCCTTTCCTGGTGCCACTGTATAAGCAAATTTTGTCTGATAGGGAA
                                                                              900
     K  S  K  R  L  P  F  L  V  P  L  Y  K  Q  I  L  S  D  R  E

5'  AAACTCTCCTGGATTGCTGAAGAGTTCGACAGCGACAAGAAGATGCTGAGCGCTATCACC
                                                                              960
     K  L  S  W  I  A  E  E  F  D  S  D  K  K  M  L  S  A  I  T
```

FIG. 4B

I - Cpf1 - PaCpf1

```
5' GAGTCTTACAACCACCTGCACAACGTGTTGATGGGTAACGAGAACGAAAGCCTGCGAAAT
                                                                    1020
    E  S  Y  N  H  L  H  N  V  L  M  G  N  E  N  E  S  L  R  N

5' CTGCTGCTGAATATTAAGGACTATAACCTGGAGAAAATTAATATCACAAACGACTTGTCT
                                                                    1080
    L  L  L  N  I  K  D  Y  N  L  E  K  I  N  I  T  N  D  L  S

5' CTCACCGAAATCTCCCAGAATCTTTTTGGCCGATATGATGTATTCACAAATGGGATCAAA
                                                                    1140
    L  T  E  I  S  Q  N  L  F  G  R  Y  D  V  F  T  N  G  I  K

5' AACAAGCTGAGAGTGTTGACTCCAAGGAAGAAAAAGGAGACGGACGAAAATTTTGAGGAC
                                                                    1200
    N  K  L  R  V  L  T  P  R  K  K  E  T  D  E  N  F  E  D

5' CGCATTAACAAAATTTTTAAGACCCAGAAGTCCTTCAGCATCGCTTTTCTGAACAAGCTG
                                                                    1260
    R  I  N  K  I  F  K  T  Q  K  S  F  S  I  A  F  L  N  K  L

5' CCTCAGCCCGAAATGGAGGATGGGAAGCCCCGGAACATTGAGGACTATTTCATTACACAG
                                                                    1320
    P  Q  P  E  M  E  D  G  K  P  R  N  I  E  D  Y  F  I  T  Q

5' GGGGCGATTAACACCAAATCTATACAGAAAGAAGATATCTTCGCCCAAATTGAGAATGCA
                                                                    1380
    G  A  I  N  T  K  S  I  Q  K  E  D  I  F  A  Q  I  E  N  A

5' TACGAGGATGCACAGGTGTTCCTGCAAATTAAGGACACCGACAACAAACTTAGCCAGAAC
                                                                    1440
    Y  E  D  A  Q  V  F  L  Q  I  K  D  T  D  N  K  L  S  Q  N
```

FIG. 4C

```
I - Cpf1 - PaCpf1
5'  AAGACGGCGGTGGAAAAGATCAAAACTTTGCTGGACGCCTTGAAGGAACTCCAGCACTTC
    ||||||||||||||||||||||||||||||||||||||||||||||||||||||||||||  1500

K  T  A  V  E  K  I  K  T  L  L  D  A  L  K  E  L  Q  H  F

5'  ATCAAACCGCTGCTGGGCTCTGGGGAGGAGAACGAGAAAGACGAACTGTTCTACGGTTCC
    ||||||||||||||||||||||||||||||||||||||||||||||||||||||||||||  1560

I  K  P  L  L  G  S  G  E  E  N  E  K  D  E  L  F  Y  G  S

5'  TTCCTGGCCATCTGGGACGAACTGGACACCATTACACCACTTTATAACAAAGTGAGAAAT
    ||||||||||||||||||||||||||||||||||||||||||||||||||||||||||||  1620

F  L  A  I  W  D  E  L  D  T  I  T  P  L  Y  N  K  V  R  N

5'  TGGCTGACCCGAAAACCATATTCAACAGAAAAAATCAAATTGAATTTCGACAACGCTCAG
    ||||||||||||||||||||||||||||||||||||||||||||||||||||||||||||  1680

W  L  T  R  K  P  Y  S  T  E  K  I  K  L  N  F  D  N  A  Q

5'  CTGCTGGGAGGGTGGGATGTCAATAAAGAACACGACTGTGCAGGTATCTTGTTGCGGAAA
    ||||||||||||||||||||||||||||||||||||||||||||||||||||||||||||  1740

L  L  G  G  W  D  V  N  K  E  H  D  C  A  G  I  L  L  R  K

5'  AACGATAGCTACTATCTCGGAATTATCAATAAGAAAACCAACCACATCTTTGATACGGAT
    ||||||||||||||||||||||||||||||||||||||||||||||||||||||||||||  1800

N  D  S  Y  Y  L  G  I  I  N  K  K  T  N  H  I  F  D  T  D

5'  ATTACGCCATCAGATGGCGAGTGCTATGACAAAATCGACTACAAGCTCCTTCCCGGGGCG
    ||||||||||||||||||||||||||||||||||||||||||||||||||||||||||||  1860

I  T  P  S  D  G  E  C  Y  D  K  I  D  Y  K  L  L  P  G  A

5'  AACAAAATGCTTCCAAAGGTGTTTTTTAGTAAGTCCCGAATCAAAGAGTTCGAGCCATCA
    ||||||||||||||||||||||||||||||||||||||||||||||||||||||||||||  1920

I - Cpf1 - PaCpf1

```
5'  GAGGCCATAATCAATTGCTATAAGAAGGGGACACACAAAAAAGGAAAAAACTTTAACCTG
                                                                    1980
     E  A  I  N  C  Y  K  K  G  T  H  K  K  G  K  N  F  N  L

5'  ACGGACTGTCACCGCCTGATCAACTTTTTTAAGACCTCAATCGAGAAACACGAGGATTGG
                                                                    2040
     T  D  C  H  R  L  I  N  F  F  K  T  S  I  E  K  H  E  D  W

5'  TCAAAATTCGGATTCAAGTTCTCCGATACCGAAACGTATGAGGATATTAGCGGTTTTTAT
                                                                    2100
     S  K  F  G  F  K  F  S  D  T  E  T  Y  E  D  I  S  G  F  Y

5'  AGAGAGGTCGAGCAGCAGGGATACAGGCTGACGAGCCATCCAGTCAGTGCCAGCTATATA
                                                                    2160
     R  E  V  E  Q  Q  G  Y  R  L  T  S  H  P  V  S  A  S  Y  I

5'  CATAGTCTGGTCAAGGAAGGAAAACTGTACCTCTTCCAAATCTGGAACAAGGACTTTTCT
                                                                    2220
     H  S  L  V  K  E  G  K  L  Y  L  F  Q  I  W  N  K  D  F  S

5'  CAATTCTCCAAGGGGACCCCTAACTTGCACACTCTCTATTGGAAGATGCTGTTTGACAAA
                                                                    2280
     Q  F  S  K  G  T  P  N  L  H  T  L  Y  W  K  M  L  F  D  K

5'  CGGAATCTTAGCGATGTGGTTTATAAGCTGAATGGCCAGGCTGAAGTGTTCTATAGAAAG
                                                                    2340
     R  N  L  S  D  V  V  Y  K  L  N  G  Q  A  E  V  F  Y  R  K

5'  AGCTCCATTGAACACCAGAACCGAATTATCCACCCCGCTCAGCATCCCATCACAAATAAG
                                                                    2400
     S  S  I  E  H  Q  N  R  I  I  H  P  A  Q  H  P  I  T  N  K
```

FIG. 4E

I - Cpf1 - PaCpf1

```
5' AATGAGCTTAACAAAAGCACACTAGCACCTTCAAATACGATATCATCAAGATCGCAGA
                                                                    2460
   N  E  L  N  K  K  H  T  S  T  F  K  Y  D  I  I  K  D  R  R

5' TACACGGTGGATAAATTCCAGTTCCATGTGCCCATTACTATAAATTTTAAGGCGACCGGG
                                                                    2520
   Y  T  V  D  K  F  Q  F  H  V  P  I  T  I  N  F  K  A  T  G

5' CAGAACAACATCAACCCAATCGTCCAAGAGGTGATTCGCCAAAACGGTATCACCCACATC
                                                                    2580
   Q  N  N  I  N  P  I  V  Q  E  V  I  R  Q  N  G  I  T  H  I

5' ATAGGCATCGATCGAGGTGAACGCCATCTTCTGTACCTCTCTCTCATCGATTTGAAAGGC
                                                                    2640
   I  G  I  D  R  G  E  R  H  L  L  Y  L  S  L  I  D  L  K  G

5' AACATCATCAAGCAGATGACTCTCAACGAAATTATTAATGAGTATAAGGGTGTGACCTAT
                                                                    2700
   N  I  I  K  Q  M  T  L  N  E  I  I  N  E  Y  K  G  V  T  Y

5' AAGACCAACTACCATAACCTCCTGGAGAAGAGGGAGAAGGAGCGGACCGAGGCCAGACAC
                                                                    2760
   K  T  N  Y  H  N  L  L  E  K  R  E  K  E  R  T  E  A  R  H

5' TCCTGGAGTAGTATTGAAAGCATAAAAGAACTGAAGGATGGATACATGTCACAGGTGATT
                                                                    2820
   S  W  S  S  I  E  S  I  K  E  L  K  D  G  Y  M  S  Q  V  I

5' CACAAAATTACGGACATGATGGTTAAGTACAATGCGATTGTGGTCCTGGAGGACCTCAAC
                                                                    2880
   H  K  I  T  D  M  M  V  K  Y  N  A  I  V  V  L  E  D  L  N
```

FIG. 4F

```
I - Cpf1 - PaCpf1
5' GGGGGGTTTATGCGAGGCCGCCAGAAGGTCGAGAAGCAGGTGTACCAGAAATTTGAAAAA
                                                                    2940
    G  G  F  M  R  G  R  Q  K  V  E  K  Q  V  Y  Q  K  F  E  K

5' AAGTTGATCGACAAGCTGAACTATCTCGTTGACAAGAAACTCGACGCTAACGAGGTCGGC
                                                                    3000
    K  L  I  D  K  L  N  Y  L  V  D  K  K  L  D  A  N  E  V  G

5' GGAGTACTGAATGCTTATCAGCTGACCAACAAGTTCGAGTCTTTCAAGAAGATTGGGAAA
                                                                    3060
    G  V  L  N  A  Y  Q  L  T  N  K  F  E  S  F  K  K  I  G  K

5' CAAAGCGGATTTTTGTTCTACATCCCCGCCTGGAACACAAGCAAAATCGATCCTATAACA
                                                                    3120
    Q  S  G  F  L  F  Y  I  P  A  W  N  T  S  K  I  D  P  I  T

5' GGGTTCGTTAATCTGTTCAACACCAGGTACGAGTCTATCAAGGAGACAAAAGTTTTTTGG
                                                                    3180
    G  F  V  N  L  F  N  T  R  Y  E  S  I  K  E  T  K  V  F  W

5' TCTAAGTTTGATATTATCCGATACAATAAAGAGAAGAATTGGTTCGAGTTCGTCTTCGAT
                                                                    3240
    S  K  F  D  I  I  R  Y  N  K  E  K  N  W  F  E  F  V  F  D

5' TACAATACCTTTACGACTAAAGCGGAGGGAACACGCACTAAGTGGACTCTGTGCACCCAC
                                                                    3300
    Y  N  T  F  T  T  K  A  E  G  T  R  T  K  W  T  L  C  T  H

5' GGCACTCGCATCCAGACATTCCGGAACCCAGAAAAGAATGCCCAGTGGGACAATAAAGAG
                                                                    3360
    G  T  R  I  Q  T  F  R  N  P  E  K  N  A  Q  W  D  N  K  E
```

FIG. 4G

```
I - Cpf1 - PaCpf1
5'   ATCAATTTGACTGAGTCCTTCAAAGCTCTGTTTGAAAAGTACAAGATCGATATCACCAGT
                                                                    3420
      I  N  L  T  E  S  F  K  A  L  F  E  K  Y  K  I  D  I  T  S

5'   AATCTCAAGGAATCCATCATGCAGGAAACCGAGAAGAAGTTCTTCCAGGAACTGCATAAT
                                                                    3480
      N  L  K  E  S  I  M  Q  E  T  E  K  K  F  F  Q  E  L  H  N

5'   CTGCTCCACCTGACCCTGCAGATGAGGAATAGCGTTACTGGAACCGACATAGACTATTTG
                                                                    3540
      L  L  H  L  T  L  Q  M  R  N  S  V  T  G  T  D  I  D  Y  L

5'   ATCAGCCCCGTTGCCGATGAGGATGGAAATTTCTATGATAGTCGCATAAATGGCAAAAAT
                                                                    3600
      I  S  P  V  A  D  E  D  G  N  F  Y  D  S  R  I  N  G  K  N

5'   TTTCCGGAGAATGCCGATGCCAATGGCGCGTACAACATCGCACGAAAGGGTCTGATGCTT
                                                                    3660
      F  P  E  N  A  D  A  N  G  A  Y  N  I  A  R  K  G  L  M  L

5'   ATTCGGCAGATCAAGCAAGCAGATCCACAGAAGAAATTCAAGTTTGAGACAATCACCAAT
                                                                    3720
      I  R  Q  I  K  Q  A  D  P  Q  K  K  F  K  F  E  T  I  T  N

5'   AAAGACTGGCTGAAATTCGCCCAAGACAAGCCCTATCTTAAAGATggcagcgggAAAAGG
                                                                    3780
      K  D  W  L  K  F  A  Q  D  K  P  Y  L  K  D  G  S  G  K  R 5'   CCGGCGGCCACGAAAAAGGCCGGCCAGGCAAAAAAGAAAAAGggatccTACCCATACGAT
                                                                    3840
      P  A  A  T  K  K  A  G  Q  A  K  K  K  K  G  S  Y  P  Y  D
```

FIG. 4H

```
I - Cpf1 - PaCpf1
5'   GTTCCAGATTACGCTTATCCCTACGACGTGCCTGATTATGCATACCCATACGATGTCCCC
     ++++++++++++++++++++++++++++++++++++++++++++++++++++++++++++   3900
     ████████████████████████████████████████████████████████████
1     V  P  D  Y  A  Y  P  Y  D  V  P  D  Y  A  Y  P  Y  D  V  P

5'   GACTATGCCTAA
     ++++++++++++                                                    3912
     ████████████
1     D  Y  A
```

FIG. 4I

Version 1: 5' ACTTTAAATAATTCTACTGTTGTAGATGAGAAGTCATTTAATAAGGCCACTGTTAAAAGTCTAAGAACTTTAAATA 3'

Version 2: 5' CTACTATTCCTGTGCCTTCAGATAATTCAGTCTAAGAACTTTAAATAATTCTACTGTTGTAGATGTCTAGAGCCTT 3'

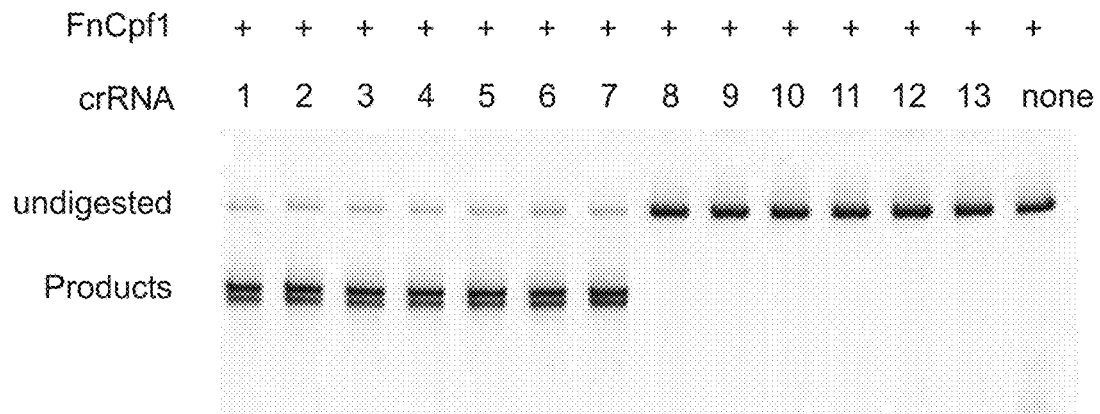

| crRNA | | | |
|---|---|---|---|
| 1 | acuuuaaauaauuucuacuguuguagau | gagaagucauuuaauaaggccacuguuaaaaagcu | gucuaagaacuuuaaau |
| 2 | acuuuaaauaauuucuacuguuguagau | gagaagucauuuaauaaggccacuguuaaaa | gucuaagaacuuuaaau |
| 3 | acuuuaaauaauuucuacuguuguagau | gagaagucauuuaauaaggccacuguuaaa | gucuaagaacuuuaaau |
| 4 | acuuuaaauaauuucuacuguuguagau | gagaagucauuuaauaaggccacuguu | gucuaagaacuuuaaau |
| 5 | acuuuaaauaauuucuacuguuguagau | gagaagucauuuaauaaggccacu | gucuaagaacuuuaaau |
| 6 | acuuuaaauaauuucuacuguuguagau | gagaagucauuuaauaaggc | gucuaagaacuuuaaau |
| 7 | acuuuaaauaauuucuacuguuguagau | gagaagucauuuaauaa | gucuaagaacuuuaaau |
| 8 | acuuuaaauaauuucuacuguuguagau | gagaagucauuuaa | gucuaagaacuuuaaau |
| 9 | acuuuaaauaauuucuacuguuguagau | agucauuuaauaaggccacuguuaaaa | gucuaagaacuuuaaau |
| 10 | acuuuaaauaauuucuacuguuguagau | cauuuaauaaggccacuguuaaaa | gucuaagaacuuuaaau |
| 11 | acuuuaaauaauuucuacuguuguagau | uaauaaggccacuguuaaaa | gucuaagaacuuuaaau |
| 12 | acuuuaaauaauuucuacuguuguagau | uaaggccacuguuaaaa | gucuaagaacuuuaaau |
| 13 | acuuuaaauaauuucuacuguuguagau | ggccacuguuaaaa | gucuaagaacuuuaaau |

FIG. 22

| Restriction Enzymes | Optimized |
|---|---|

*Green: filtered sites; Blue: checked sites (not filtered); Red: kept sites.*

| | |
|---|---|
| BamHI (GGATCC) | 1(3754) |
| EcoRI (GAATTC) | 1(3844) |
| HindIII (AAGCTT) | 0 |
| BsmBI (CGTCTC) | 0 |
| BsaI (GGTCTC) | 0 |
| BbsI (GAAGAC) | 0 |
| AgeI (ACCGGT) | 0 |
| XhoI (CTCGAG) | 0 |
| NdeI (CATATG) | 1(3818) |
| NotI (GCGGCCGC) | 0 |
| KpnI (GGTACC) | 1(1) |
| BsrGI (TGTACA) | 0 |
| SpeI (ACTAGT) | 0 |
| XbaI (TCTAGA) | 0 |
| NheI (GCTAGC) | 0 |
| ARE | 0 |

| CIS-Acting Elements | Optimized |
|---|---|
| Splice (GGTAAG) | 0 |
| Splice (GGTGAT) | 0 |
| PolyA (AATAAA) | 0 |
| PolyA (ATTAAA) | 0 |
| Destabilizing (ATTTA) | 0 |
| Poly T (TTTTTT) | 0 |
| PolyA (AAAAAA) | 0 |

| Antiviral Motifs | Optimized |
|---|---|
| | 0 |

FIG. 28D

After Optimization

Max Direct Repeat: Size:15 Distance:2688 Frequency:2
Max Inverted Repeat: None
Max Dyad Repeat: Size:13 Tm: 49.0 Start Positions: 1666, 1908

FIG. 28E

```
ATGGATTACGGCAACGGCCAGTTTGAGCGGAGAGCCCCCCTGACCAAGACAATCACCCTGCGCCTGAAGCCTATC
GGCGAGACACGGGAGACAATCCGCGAGCAGAAGCTGCTGGAGCAGGACGCCGCCTTCAGAAAGCTGGTGGAGACA
GTGACCCCTATCGTGGACGATTGTATCAGGAAGATCGCCGATAACGCCCTGTGCCACTTTGGCACCGAGTATGAC
TTCAGCTGTCTGGGCAACGCCATCTCTAAGAATGACAGCAAGGCCATCAAGAAGGAGACAGAGAAGGTGGAGAAG
CTGCTGGCCAAGGTGCTGACCGAGAATCTGCCAGATGGCCTGCGCAAGGTGAACGACATCAATTCCGCCGCCTTT
ATCCAGGATACACTGACCTCTTTCGTGCAGGACGATGCCGACAAGCGGGTGCTGATCCAGGAGCTGAACGGCAAG
ACCGTGCTGATGCAGCGGTTCCTGACCACACGGATCACAGCCCTGACCGTGTGGCTGCCCGACAGAGTGTTCGAG
AACTTTAATATCTTCATCGAGAACGCCGAGAAGATGAGGAATCCTGCTGGACTCCCCTCTGAATGAGAAGATCATG
AAGTTTGACCCAGATGCCGAGCAGTACGCCTCTCTGGAGTTCTATGGCCAGTGCCTGTCTCAGAAGGACATCGAT
AGCTACAACCTGATCATCTCCGGCATCTATGCCGACGATGAGGTGAAGAACCCTGGCATCAATGAGATCGTGAAG
GAGTACAATCAGCAGATCCGGGGCGACAAGGATGAGTCCCCACTGCCCAAGCTGAAGAAGCTGCACAAGCAGATC
CTGATGCCAGTGGAGAAGGCCTTCTTTGTGCGCGTGCTGTCTAACGACAGCGATGCCCGGAGCATCCTGGAGAAG
ATCCTGAAGGACACAGAGATGCTGCCCTCCAAGATCATCGAGGCCATGAAGGAGGCAGATGCAGGCGACATCGCC
GTGTACGGCAGCCGGCTGCACGAGCTGAAGCCACGTGATCTACGGCGATCACGGCAAGCTGTCCCAGATCATCTAT
GACAAGGAGTCCAAGAGGATCTCTGAGCTGATGGAGACACTGTCTCCAAAGGAGCGCAAGGAGAGCAAGAAGCGG
CTGGAGGGCCTGGAGGAGCACATCAGAAAGTCTACATACACCCTTCGACGAGCTGAACAGGTATGCCGAGAAGAAT
GTGATGGCAGCATACATCGCAGCAGTGGAGGAGTCTTGTGCCGAGATCATGAGAAAGGAGAAGGATCTGAGGACC
CTGCTGAGCAAGGAGGACGTGAAGATCCGGGGCAACAGACACAATACACTGATCGTGAAGAACTACTTTAATGCC
TGGACCGTGTTCCGGAACCTGATCAGAATCCTGAGGCGCAAGTCCGAGGCCGAGATCGACTCTGACTTCTACGAT
GTGCTGGACGATTCCGTGGAGGTGCTGTCTCTGACATACAAGGGCGAGAATCTGTGCCGCAGCTATATCACCAAG
AAGATCGGCTCCGACCTGAAGCCCGAGATCGCCACATACGGCAGCGCCCTGAGGCCTAACAGCCGCTGGTGGTCC
CCAGGAGAGAAGTTTAATGTGAAGTTCCACACCATCGTGCGGAGAGATGGCCGGCTGTACTATTTCATCCTGCCC
AAGGGCGCCAAGCCTGTGGAGCTGGAGGACATGGATGGCGACATCGAGTGTCTGCAGATGAGAAAGATCCCTAAC
CCAACAATCTTTCTGCCCAAGCTGGTGTTCAAGGACCCTGAGGCCTTCTTTAGGGATAATCCAGAGGCCGACGAG
TTCGTGTTTCTGAGCGGCATGAAGGCCCCCGTGACAATCACCAGAGAGACATACGAGGCCTACAGGTATAAGCTG
TATACCGTGGGCAAGCTGCGCGATGGCGAGGTGTCCGAAGAGGAGTACAAGCGGGCCCTGCTGCAGGTGCTGACC
GCCTACAAGGAGTTTCTGGAGAACAGAATGATCTATGCCGACCTGAATTTCGGCTTTAAGGATCTGGAGGAGTAT
AAGGACAGCTCCGAGTTTATCAAGCAGGTGGAGACACACAACACCTTCATGTGCTGGGCCAAGGTGTCTAGCTCC
CAGCTGGACGATCTGGTGAAGTCTGGCAACGGCCTGCTGTTCGAGATCTGGAGCGAGCGCCTGGAGTCCTACTAT
AAGTACGGCAATGAGAAGGTGCTGCGGGGCTATGAGGGCGTGCTGCTGAGCATCCTGAAGGATGAGAACCTGGTG
TCCATGCGGACCCTGCTGAACAGCCGGCCCATGCTGGTGTACCGGCCAAAGGAGTCTAGCAAGCCTATGGTGGTG
CACCGGGATGGCAGCAGAGTGGTGGACAGGTTTGATAAGGACGGCAAGTACATCCCCCCTGAGGTGCACGACGAG
CTGTATCGCTTCTTTAACAATCTGCTGATCAAGGAGAAGCTGGGCGAGAAGGCCCGGAAGATCCTGGACAACAAG
AAGGTGAAGGTGAAGGTGCTGGAGAGCGAGAGAGTGAAGTGGTCCAAGTTCTACGATGAGCAGTTTGCCGTGACC
TTCAGCGTGAAGAAGAACGCCGATTGTCTGGACACCACAAAGGACCTGAATGCCGAAGTGATGGAGCAGTATAGC
GAGTCCAACAGACTGATCCTGATCAGGAATACCACAGATATCCTGTACTATCTGGTGCTGGACAAGAATGGCAAG
GTGCTGAAGCAGAGATCCCTGAACATCATCAATGACGGCGCCAGGGATGTGGACTGGAAGGAGAGGTTCCGCCAG
GTGACAAAGGATAGAAACGAGGGCTACAATGAGTGGGATTATTCCAGGACCTCTAACGACCTGAAGGAGGTGTAC
```

FIG. 28F

CTGAATTATGCCCTGAAGGAGATCGCCGAGGCCGTGATCGAGTACAACGCCATCCTGATCATCGAGAAGATGTCT
AATGCCTTTAAGGACAAGTATAGCTTCCTGGACGACGTGACCTTCAAGGGCTTCGAGACAAAGCTGCTGGCCAAG
CTGAGCGATCTGCACTTTAGGGGCATCAAGGACGGCGAGCCATGTTCCTTCACAAACCCCCTGCAGCTGTGCCAG
AACGATTCTAATAAGATCCTGCAGGACGGCGTGATCTTTATGGTGCCAAATTCTATGACACGGAGCCTGGACCCC
GACACCGGCTTCATCTTTGCCATCAACGACCACAATATCAGGACCAAGAAGGCCAAGCTGAACTTTCTGAGCAAG
TTCGATCAGCTGAAGGTGTCCTCTGAGGGCTGCCTGATCATGAAGTACAGCGGCGATTCCCTGCCTACACACAAC
ACCGACAATCGCGTGTGGAACTGCTGTTGCAATCACCCAATCACAAACTATGACCGGGAGACAAAGAAGGTGGAG
TTCATCGAGGAGCCCGTGGAGGAGCTGTCCCGCGTGCTGGAGGAGAATGGCATCGAGACAGACACCGAGCTGAAC
AAGCTGAATGAGCGGGAGAACGTGCCTGGCAAGGTGGTGGATGCCATCTACTCTCTGGTGCTGAATTATCTGCGC
GGCACAGTGAGCGGAGTGGCAGGACAGAGGGCCGTGTACTATAGCCCTGTGACCGGCAAGAAGTACGATATCTCC
TTTATCCAGGCCATGAACCTGAATAGGAAGTGTGACTACTATAGGATCGGCTCCAAGGAGAGGGGAGAGTGGACC
GATTTCGTGGCCCAGCTGATCAAC
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 28G

MDYGNGQFERRAPLTKTITLRLKPIGETRETIREQKLLEQDAAFRKLVETVTPIVDDCIR
KIADNALCHPGTEYDFSCLGNAISKNDSKAIKKETEKVEKLLAKVLTENLPDGLRKVNDI
NSAAFIQDTLTSFVQDDADKRVLIQELKGKTVLMQRFLTTRITALTVWLPDRVFENFNIF
IENAEKMRILLDSPLNEKIMKFDPDAEQYASLEFYGQCLSQKDIDSYNLIISGIYADDEV
KNPGINEIVKEYNQQIRGDKDESPLPKLKKLHKQILMPVEKAFFVRVLSNDSDARSILEK
ILKDTEMLPSKIIEAMKEADAGDIAVYGSRLHELSHVIYGDHGKLSQIIYDKESKRISEL
METLSPKERKESKKRLEGLEEHIRKSTYTFDELNRYAEKNVMAAYIAAVEESCAEIMRKE
KDLRTLLSKEDVKIRGNRHNTLIVKNYFNAWTVFRNLIRILRRKSEAEIDSDFYDVLDDS
VEVLSLTYKGENLCRSYITKKIGSDLKPEIATYGSALRPNSRWWSPGEKFNVKFHTIVRR
DGRLYYFILPKGAKPVELEDMDGDIECLQMRKIPNPTIFLPKLVFKDPEAFFRDNPEADE
FVFLSGMKAPVTITRETYEAYRYKLYTVGKLRDGEVSEEEYKRALLQVLTAYKEFLENRM
IYADLNPGFKDLEEYKDSSEPIKQVETHNTPMCWAKVSSSQLDDLVKSGNGLLFEIWSER
LESYYKYGNEKVLRGYEGVLLSILKDENLVSMRTLLNSRPMLVYRPKESSKPMVVHRDGS
RVVDRFDKDGKYIPPEVHDELYRFFNNLLIKEKLGEKARKILDNKKVKVKVLESERVKWS
KPYDEQPAVTFSVKKNADCLDTTKDLNAEVMEQYSESNRLILIRNTTDILYYLVLDKNGK
VLKQRSLNIINDGARDVDWKERFRQVTKDRNEGYNEWDYSRTSNDLKEVYLNYALKEIAE
AVIEYNAILIIEKMSNAFKDKYSFLDDVTFKGFETKLLAKLSDLHFRGIKDGEPCSFTNP
LQLCQNDSNKILQDGVIFMVPNSMTRSLDPDTGFIPAINDHNIRTKKAKLNFLSKFDQLK
VSSEGCLIMKYSGDSLPTHNTDNRVWNCCCNHPITNYDRETKKVEFIEEPVEELSRVLEE
NGIETDTELNKLNERENVPGKVVDAIYSLVLNYLRGTVSGVAGQRAVYYSPVTGKKYDIS
FIQAMNLNRKCDYYRIGSKERGEWTDFVAQLIN

FIG. 28H

| Restriction Enzymes | Optimized |
|---|---|
| *Green: filtered sites; Blue: checked sites (not filtered); Red: kept sites | |
| BamHI(GGATCC) | 1(3778) |
| EcoRI(GAATTC) | 1(3868) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(3842) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

| CIS-Acting Elements | Optimized |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

| Antiviral Motifs | Optimized |
|---|---|
| | 0 |

FIG. 29D

After Optimization
  Max Direct Repeat:    Size:12 Distance:3285 Frequency:2
  Max Inverted Repeat:  Size: 12 Tm: 43.5 Start Positions: 1631, 1547
  Max Dyad Repeat:      None

GAGGCCTACGTGGAGCTGGCCGTGACCCAGATCTCTCCAAGCTGGCCACAAAGTATAACGCCGTGGTGGTGGTGGAG
TCCATGTCCTCTACCTTCAAGGACAAGTTCTCTTTTCTGGATGAGCAGATCTTCAAGGCCTTTGAGGCCCGGCTG
TGCGCCAGAATGTCCGACCTGTCTTTTAATACAATCAAGGAGGGCGAGGCCGGCTCCATCTCTAACCCCATCCAG
GTGTCCAACAATAACGGCAATTCTTATCAGGACGGCGTGATCTACTTCCTGAATAACGCCTATACCCGGACCCTG
TGCCCTGATACCCGGCTTTGTGCACGTGTTCGATAAGACCCGGCTGATCACAATGCAGTCTAAGAGACAGTTCTTT
GCCAAGATGAAGGACATCAGAATCGGACGATGGCGGAGATGCTGTTTCACCTTTAACCTGGAGGAGTACCCTACAAAG
AGGCTGCTGGACCCGCAAGGAGTGGACCGTGAAGATCGCCCGGCGATGGCTCCTATTTCGACAAGGATAAGGGCGAG
TACGTGTACGTGAACGACATCGTGAGAGAGCAGATCATCCCAGCCCTGCTGGAGGACAAGGCCGTGTTCGATGGC
AATATGGCCGAGAAGTTTCTGGATAAGACCGCCATCAGCGGCAAGTCCGTGGAGCTGATCTACAAGTGGTTCGCC
AACGCCCTGTATGGCATCATCAAAAGAAGAACGGCGAGAAGATCTACCGGAGCCCCATCACCGGCACAGAGATC
GACGTGAGCAAGAACACCACATACAACTTCGGCAAGAAGTTCATGTTCAAGCAGGAGTATAGAGGCGACGGCGAT
TTTCTGGACGGCCTTCCTGAATTACATGCAGGCCCAGGATATGCCCGTG
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 29G

MLLYENYTKRNQITKSLRLELRPQGKTLRNIKELNLLEQDKAIYALLERLKPVIDEGIKD
IARDTLKNCELSFEKLYEHPLSGDKKAYAKESERLKKEIVKTLIKNLPEGIGKISBINSA
KYLNGVLYDFIDKTHKDSEEKQNILSDILETKGYLALFSKFLTSRITTLEQSMPKRVIEN
FEIYAANIPKMQDALERGAVSFAIEYESICSVDYYNQILSQEDIDSYNRLISGIMDEDGA
KEKGINQTISEKNIKIKSEHLEEKPPRILKQLHKQILEEREKAPTIDHIDSDEEVVQVTK
EAFEQTKEQWENIKKINGFYAKDPGDITLFIVVGPNQTHVLSQLIYGEHDRIRLLLEEYE
KNTLEVLPERTKSEKARYDKFVNAVPKKVAKESHTFDGLQKMTGDDRLFILYRDELARNY
MRIKEAYGTPERDILKSREGIKGNRDVQESLVSFYDELTKFRSALRIINSGNDEKADPIF
YNTFDGIFEKANRTYKAENLCRNYVTKSPADDARIMASCLGTPARLRTHWWNGEENFAIN
DVAMIRRGDEYYYFVLTPDVKFVDLKTKDETDAQIFVQRKGAKSFLGLPKALPKCILEFY
FESPEHKNDKNCVIEEYVSKPLTIDRRAYDIFKNGTPKKTNIGIDGLTEEKFKDDCRYLI
DVYKEPIAVYTRYSCFNMSGLKRADEYNDIGEFFSDVDTRLCTMEWIPVSPERINDMVDK
KEGLLPLVRSMFLYNRPRKPYERTFIQLFSDSNMEHTSMLLNSRAMIQYRAASLPRRVTH
KKGSILVALRDSNGEHIPMHIREAIYKMKNNFDISSEDFIMAKAYLAEHDVAIKKANEDI
IRNRRYTEDKFFLSLSYTKNADISARTLDYINDKVEEDTQDSRMAVIVTRNLKDLTYVAV
VDEKNNVLEEKSLNEIDGVNYRELLKERTKIKYHDKTRLNQYDVSSKGLKEAYVELAVTQ
ISKLATKYNAVVVVESMSSTFKDKFSFLDEQIFKAFEARLCARMSDLSFNTIKEGEAGSI
SNPIQVSNNNGNSYQDGVIYFLNNAYTRTLCPDTGFVDVFDKTRLITMQSKRQFFAKMKD
IRIDDGEMLPTFNLEEYPTKRLLDRKEWTVKIAGDGSYFDKDKGEYVYVNDIVREQIIPA
LLEDKAVFDGNMAEKFLDKTAISGKSVELIYKWFANALYGIITKKDGEKIYRSPITGTEI
DVSKNTTYNPGKKPMFKQEYRGDGDFLDAPLNYMQAQDIAV

FIG. 29H

| Restriction Enzymes | Optimized |
|---|---|
| BamHI(GGATCC) | 1(4488) |
| EcoRI(GAATTC) | 1(4576) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(4550) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

*Green: filtered sites; Blue: checked sites (not filtered); Red: kept sites.

| CIS-Acting Elements | Optimized |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

| Antiviral Motifs | Optimized |
|---|---|
| | 0 |

FIG. 30D

After Optimization
   Max Direct Repeat:   Size:15 Distance:3543 Frequency:2
   Max Inverted Repeat: None
   Max Dyad Repeat:   None

FIG. 30E

```
ATGTCCAACTTCTTTAAGAATTTCACCAACCTGTATGAGCTGTCCAAGACACTGAGGTTTGAGCTGAAGCCCGTG
GGCGACACCCTGACAAACATGAAGGACCACCTGGAGTACGATGAGAAGCTGCAGACCTTCCTGAAGGATCAGAAT
ATCGACGATGCCTATCAGGCCCTGAAGCCTCAGTTCGACGAGATCCACGAGGAGTTTATCACAGATTCTCTGGAG
AGCAAGAAGGCCAAGGAGATCGACTTCTCCGAGTACCTGGATCTGTTTCAGGAGAAGAAGGAGCTGAACGACTCT
GAGGAGAAGCTGCGCAACAAGATCGGCGAGACATTCAACAAGGCCGGCGAGAAGTGGAAGAAGGAGAAGTACCCT
CAGTATGAGTGGAAGAAGGGCTCCAAGATCGCCGATGGCGGCGACATCCTGTCTTGCCAGGATATGCTGCAGTTT
ATCAAGTATAAGAACCCAGAGGATGAGAAGATCAAGAATTACATCGACGATACACTGAAGGGCTTCTTTACCTAT
TTCGGCGGCTTTAATCAGAACAGGGCCAACTACTATGAGACAAAGAAGGAGCCTCCACCGCAGTGGCAACAAGG
ATCGTGCACGAGAACCTGCCAAAGTTCTGTGACAAGTGATCCAGTTTAAGCACATCATCAAGCGGAAGAAGGAT
GGCACCGTGGAGAAAACCGAGAGAAAGGACCGAGTACCTGAACGCCTACCAGTATCTGAAGAACAATAACAAGATC
ACACAGATCAAGGACGCCGAGACAGAGAAGATGATCGAGTCTACACCCATCGCCGAGAAGATCTTCGACGTGTAC
TACTTCAGCAGCTGCCTGAGCCAGAAGCGGATCGAGGAGTACAACCGGATCATCGGCCACTATAATCTGCTGATC
AACCTGTATAACCAGGCCAAGAGATCTGAGGGCAAGCACCTGAGCGCCAACGAGAAGAAGTATAAGGACCTGCCT
AAGTTCAAGACCCTGTATAAGCAGATCGGCTGCGGCAAGAAGAAGGACCTGTTTTACACAATCAAGTGTGATACC
GAGGAGGAGGCCAATAAGTCCCGGAACGAGGGCAAGGAGTCCCACTCTGTGGAGGAGATCATCAACAAGGCCCAG
GAGGCCATCAATAAGTACTTCAAGTCTAATAACGACTGTGAGAATATCAACACCGTGCCCGACTTCATCAACTAT
ATCCTGACAAAGGAGAATTACGAGGGCGTGTATTGGAGCAAGGCCGCCATGAACACCATCTCCGACAAGTACTTC
GCCAATTATCACGACCTGCAGGATAGACTGAACGAGGCCAAGGTGTTTCAGAAGGCCGATAAGAAGTCCGAGGAC
GATATCAAGATCCCAGAGGCCATCGAGCTGTCTGGCCTGTTCGGCGTGCTGGACAGCCTGGCCGATTGGCAGACC
ACACTGTTTAAGTCTACCATCCTGAGCAACGAGGACAAGCTGAAGATCATCACAGATTCCCAGACCCCCCTCTGAG
GCCCTGCTGAAGATGATCTTCAATGACATCGAGAAGAACATGGAGTCCTTTCTGAAGGAGACAAACGATATCATC
ACCCTGAAGAAGTATAAGGGCAATAAGGAGGGCACCGAGAAGATCAAGCAGTGGTTCGACTATACACTGGCCATC
AACCGGATGCTGAAGTACTTCCTGGTGAAGGACGAATAAGATCAAGGGCAACTCCCTGGATACCAATATCTCTGAG
GCCCTGAAAACCCTGATCTACAGCGACGATGCCGAGTGGTTCAAGTGGTACGACGCCCTGAGAAACTATCTGACC
CAGAAGCCTCAGGATGAGGCCAAGGAGAATAAGCTGAAGCTGAATTTCGACAACCCATCTCTGGCCGGCGGCTGG
GATGTGAACAAGGAGTGCAGCAATTTTTGCGTGATCCTGAAGGACAAGAACGAGAAGAAGTACCTGGCCATCATG
AAGAAGGGCGAGAATACCCTGTTCCAGAAGGAGTGGACAGAGGGCCGGGGCAAGAACCTGACAAAGAAGTCTAAT
CCACTGTTCGAGATCAATAACTGCGAGATCCTGAGCAAGATGGAGTATGACTTTTGGGCCGACGTGAGCAAGATG
ATCCCCAAGTGTAGCACCCAGCTGAAGGCCGTGGTGAACCACTTCAAGCAGTCCGACAATGAGTTCATCTTTCCT
ATCGGCTACAAGGTGACAAGCGGCGAGAAGTTTAGGGAGGAGTGCAAGATCTCCAAGCAGGACTTCGGGCTGAAT
AACAAGGTGTTTAATAAGAACGAGCTGAGCGTGACCGCCATGCGCTACGATCTGTCCTCTACACAGGAGAAGCAG
TATATCAAGGCCTTCCAGAAGGAGTACTGGGAGCTGCTGTTTAAGCAGGAGAAGCCGGACACCAAGCTGACAAAT
AAGGAGATCTTCAACGAGTGGATCAATTTTTGCAACAAGAAGTATAGCGAGCTGCTGTCCTGGAGAGAAAGTAC
AAGGATGCCCTGACCAATTGGATCAACTTCTGTAAGTACTTTCTGAGCAAGTATCCCAAGACCACACTGTTCAAC
TACTCTTTTAAGGAGAGCGAGAATTATAACTCCCTGGACGAGTTCTACCGGGACGTGGATATCTGTTCTTACAAG
CTGAATATCAACACCACAATCAATAAGGACATCCTGGATAGACTGGTGGAGGAGGGCAAGCTGTACCTGTTTGAG
ATCAAGAATCAGGACACGAACGATGGCAAGTCCATCGGCCACAAGAATAACCTGCACACCATCTACTGGAACGCC
ATCTTCGAGAATTTTGACAACAGGCCTAAGCTGAATGGCGAGGCCGAGATCTTCTATCGGAAGGCCATCTCCAAG
```

FIG. 30F

GATAAGCTGGGCATCGTGAAGGGCAAGAAAACCAAGAACGGCACCGAGATCATCAAGAATTACAGATTCAGCAAG
GAGAAGTTTATCCTGCACGTGCCAATCACCCTGAACTTCTGCTCCAATAACGAGTATGTGAATGACATCGTGAAC
ACAAAGTTCTACAATTTTTCCAACCTGCACTTTCTGGGCATCGATAGGGCCGAGAAGCACCTGGCCTACTATTCT
CTGGTGAATAAGAACGGCCGAGATCGTGGACCAGGGCACACTGAACCTGCCCTTTCACCGACAAGGATGGCAATCAG
CGCAGCATCAAGAAGGAGAAGTACTTTTATAACAAGCAGGAGGACAAGTGGGAGGCCAAGGAGGTGGATTGTTGG
AATTATAACGACCTGCTGGATGCCATGGCCTCTAACCGGGACATGGCCAGAAAGAATTGGCAGAGGATCGGCACC
ATCAAGGAGGCCAAGAACGGCTACGTGAGCCTGGTCATCAGGAAGATCGCCGATCTGGCCGTGAATAACGAGCGC
CCCGGCCTTCATCGTGCTGGAGGACCTGAATACAGGCTTTAAGCGGTCCAGACAGAAGATCGATAAGAGCGTGTAC
CAGAAGTTCGAGCTGGCCCTGGCCAAGAAGCTGAACTTTCTGGTGGACAAGAATGCCAAGCGCGATGAGATCGGC
TCCCCTACAAAGGCCCTGCAGCTGACCCCCCCCTGTGAATAACTACGGCGACATTGAGAACAAGAAGCAGGCCGGC
ATCATGCTGTATACCCGGGCCAATTATACCTCTCAGACAGATCCAGCCACAGGCTGGAGAAAGACCATCTATCTG
AAGGCCGGCCCCGAGGAGACAACATACAAGAAGGACGGCAAGATCAAGAACAAGGCCGTGAAGGACCAGATCATC
GAGACATTCACCGATATCGGCTTTGACGGCAAGGATTACTATTTCGAGTACGACAAGGGCGAGTTTGTGGATGAG
AAAACCGGCGAGATCAAGCCCAAGAAGTGGCGGCTGTACTCCGGCGAGAATGGCAAGTCCCTGGACAGGTTCCGC
GGAGAGAGGGAGAAGGATAAGTATGAGTGGAAGATCGACAAGATCGATATCGTGAAGATCCTGGACGATCTGTTC
GTGAATTTTGACAAGAACATCAGCCTGCTGAAGCAGCTGAAGGAGGGCGTGGAGCTGACCCGGAATAACGAGCGC
GGCACGGCGAGTCCCTGAGATTCGCCATCAACCTGATCCAGCAGATCCGGAATACCGGCAATAACGGAGAGAC
AACGATTTCATCCTGTCCCCAGTGAGGGACGAGAATGGCAAGCACTTTGACTCTCGCGAGTACTGGGATAAGGAG
ACAAAGGGCGAGAAGATCAGCATGCCCAGCTCCGGCGATGCCAATGGCGCCTTCAACATCGCCCGGAAGGGCATC
ATCATGAACGCCCACATCCTGGCCAATAGCGACTCCAAGGATCTGTCCCTGTTCGTGTCTGACGAGGAGTGGGAT
CTGCACCTGAATAACAAGACCGAGTGGAAGAAGCAGCTGAACATCTTTTCTAGCAGGAAGGCCATGGCCAAGCGC
AAGAAG
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 30G

MSNFFKNPTNLYELSKTLRFELKPVGDTLTNMKDHLEYDEKLQTFLKDQNIDDAYQALKP
QFDEIHEEFITDSLESKKAKEIDFSEYLDLFQEKKELNDSEKKLRNKIGETFNKAGEKWK
KEKYPQYEWKKGSKIANGADILSCQDMLQFIKYKNPEDEKIKNYIDDTLKGFFTYFGGFN
QNRANYYETKKEASTAVATRIVHENLPKFCDNVIQFKHIIKRKKDGTVEKTERKTEYLNA
YQYLKNNNKITQIKDAETEKMIESTPIAEKIFDVYYFSSCLSQKQIEEYNRIIGHYNLLI
NLYNQAKRSEGKHLSANEKKYKDLPKFKTLYKQIGCGKKKDLPYTIKCDTEEEANKSRNE
GKESHSVEEIINKAQEAINKYFKSNNDCENINTVPDFINYILTKENYEGVYWSKAAMNTI
SDKYFANYHDLQDRLKEAKVFQKADKKSEDDIKIPEAIELSGLPGVLDSLADWQTTLFKS
SILSNEDKLKIITDSQTPSEALLKMIFNDIEKNMESFLKETNDIITLKKYKGNKEGTEKI
KQWFDYTLAINRMLKYFLVKENKIKGNSLDTNISEALKTLIYSDDAEWFKWYDALRNYLT
QKFQDEAKENKLKLNFDNPSLAGGWDVNKECSNFCVILKDKNEKKYLAIMKKGENTLFQK
EWTEGRGKNLTKKSNPLFEINNCEILSKMEYDFWADVSKMIPKCSTQLKAVVNHPKQSDN
EFIFPIGYKVTSGEKFREECKISKQDFELNNKVFNKNELSVTAMRYDLSSTQEKQYIKAF
QKEYWELLFKQEKRDTKLTRNEIFNEWINFCNKKYSELLSWERKYKDALTRWINFCKYFL
SKYPKTTLFNYSPKESENYNSLDEFYRDVDICSYKLNINTTINKSILDRLVEEGKLYLFE
IKNQDSNDGKSIGHKNNLHTIYWNAIFENPDNEPKLNGEAEIPYRKAISKDKLGIVKGKK
TKNGTEIIKNYRFSKEKFILHVPITLNFCSNNEYVNDIVNTKFYNFSNLHFLGIDRGEKH
LAYYSLVNKNGEIVDQGTLNLPFTDKDGNQRSIKKEKYFYNKQEDKWEAKEVDCWNYNDL
LDAMASNRDMARKNWQRIGTIKEAKNGYVSLVIRKIADLAVNNERPAFIVLEDLNTGFKR
SRQKIDKSVYQKFELALAKKLNPLVDKNAKRDEIGSPTKALQLTPPVNNYGDIENKKQAG
IMLYTRANYTSQTDPATGWRKTIYLKAGPEETTYKKDGKIKNKSVKDQIIETPTDIGFDG
KDYYFEYDKGEFVDEKTGEIKPKKWRLYSGENGKSLDRFRGEREKDKYEWKIDKIDIVKI
LDDLFVNFDKNISLLKQLKEGVELTRNNEHGTGESLRPAINLIQQIRNTGNNERDNDFIL
SPVRDENGKHFDSREYWDKETKGEKISMPSSGDANGAFNIARKGIIMNAHILANSDSKDL
SLFVSDEEWDLHLNNKTEWKKQLNIPSSRKAMAKRKK

FIG. 30H

| Restriction Enzymes | Optimized |
|---|---|
| *Green: filtered sites; Blue: checked sites (not filtered); Red: kept sites | |
| BamHI(GGATCC) | 1(4111) |
| EcoRI(GAATTC) | 1(4201) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(4175) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

| CIS-Acting Elements | Optimized |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

| Antiviral Motifs | Optimized |
|---|---|
| | 0 |

FIG. 31D

After Optimization
   Max Direct Repeat:   Size:14 Distance:2001 Frequency:2
   Max Inverted Repeat: None
   Max Dyad Repeat:    None

AATGGCGTGAACTACCGGGACAAGCTGATCGAGAGGGAGAAGGAGCGCCTGAAGAACCGGCAGAGCTGGAAGCCT
GTGGTGAAGATCAAGGATCTGAAGAAGGGCTACATCTCCCACGTGATCCACAAGATCTGCCGGCTGATCGAGAAG
TATTCTGCCATCGTGGTGCTGGAGGACCTGAATATGAGATTCAAGCAGATCAGGGGAGGAATCGAGCGGAGCGTG
TACCAGCAGTTCGAGAAGGGCCCTGATCGATAAGCTGGGCTATCTGGTGTTTAAGGACAACAGGGATCTGAGCGCA
CCAGGAGGCGTGCTGAATGGCTACCAGCTGTCTGCCCCCTTTGTGAGCTTCGAGAAGATGCGCAAGCAGACCGGC
ATCCTGTTCTACACACAGGCCGAGTATACCAGCAAGACAGACCCAATCACCGGCTTTCGGAAGAACGTGTATATC
TCTAATAGCGCCTCCCTGGATAAGATCAAGGAGGCCGTGAAGAAGTTCGACGCCATCGGCTGGGATGGCAAGGAG
CAGTCTTACTTCTTTAAGTACAACCCCTTACAACCTGGCCGACGAGAAGTATAAGAACTCTACCGTGAGCAAGGAG
TGGGCCATCTTTGCCAGCGGCCCCAAGAATCCGGAGACAGAAGGGCGAGGACGGCTACTGGAAGTATGATAGGGTG
AAAGTGAATGAGGAGTTCGAGAAGCTGCTGAAGGTCTGGAATTTTGTGAACCCAAAGGCCACAGATATCAAGCAG
GAGATCATCAAGAAGGAGAAGGCAGGCGACCTGCAGGGAGAGAAGGAGCTGGATGGCCGGCTGAGAAACTTTTGG
CACTCTTTCATCTACCTGTTTTAACCTGGTGCTGGAGCTGCGCAATTCTTTCAGCCTGCAGATCAAGATCAAGGCA
GGAGAAGTGATCGCAGTGGACCAGGGCGGTGGACTTCATCGCCAGCCCAGTGAAGCCCTTCTTTACCACACCCAAC
CCTTACATCCCCTCCAACCTGTGCTGGCTGGCCGTGGAGAATGCAGACGCAAACGGAGCCTATAATATCGCCAGG
AAGGGCGTGATGATCCTGAAGAAGATCCGCGAGCACGCCAAGAAGGACCCCGAGTTCAAGAAGCTGCCAAACCTG
TTTATCAGCAATGCAGAGTGGGACGGAGGGCAGCCCGGGATTGGGGCAAGTACGCAGGCACCACAGCCCTGAACCTG
GACCAC
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 31G

MENIPDQFIGKYSLSKTLRFELKPVGKTEDFLKINKVFEKDQTIDDSYNQAKFYFDSLHQ
KPIDAALASDKTSELSPQNPADVLEKQNKIILDKKREMGALRKRDKNAVGIDRLQKEIND
AEDIIQKEKEKIYKDVRTLFDNEAESWKTYYQEREVDGKKITPSKADLKQKGADFLTAAG
ILKVLKYEFPEEKEKEPQAKNQPSLFVEEKENPGQKRYIFDSFDKFAGYLTKPQQTKKNL
YAADGTSTAVATRIADNFIIFHQNTKVFRDKYKNNHTDLGFDEENIFEIERYKNCLLQRE
IEHIKNENSYNKIIGRINKKIKEYRDQKAKDTKLTKSDFPFFKNLDKQILGEVEKEKQLI
EKTREKTEEDVLIERPKEPIENNEERFTAAKKLMNAFCNGEFESEYEGIYLKNKAINTIS
RRWFVSDRDFELKLPQQKSKNKSEKNEPKVKKFISIAEIKNAVEELDGDIFKAVFYDKKI
IAQGGSKLEQFLVIWKYEFEYLFRDIERENGEKLLGYDSCLKIAKQLGIPPQEKEAREKA
TAVIKNYADAGLGIFQMMKYFSLDDKDRKNTPGQLSTNFYAEYDGYYKDFEPIKYYNEFR
NPITKKPFDEDKIKLNPENGALLKGWDENKEYDFMGVILKKEGRLYLGIMHKNHRKLPQS
MGNAKGDNANRYQKMIYKQIADASKDVPRLLLTSKKAMEKFKPSQEILRIKKEKTFKRES
KNFSLRDLHALIEYYRNCIPQYSNWSFYDPQFQDTGKYQNIKEFTDDVQKYGYKISFRDI
DDEYINQALNEGKMYLPEVVNKDIYNTKNGSKNLHTLYFEHILSAENLNDPVFKLSGMAE
IFQRQPSVNEREKITTQKNQCILDKGDRAYKYRRYTEKKIMFHMSLVLNTGKGEIKQVQF
NKIINQRISSSDNEMRVNVIGIDRGEKNLLYYSVVKQNGEIIEQASLNEINGVNYRDKLI
EREKERLKNRQSWKPVVKIKDLKKGYISHVIHKICQLIEKYSAIVVLEDLNMRFKQIRGG
IERSVYQQFEKALIDKLGYLVFKDNRDLRAPGGVLNGYQLSAPFVSFEKMRKQTGILFYT
QAEYTSKTDPITGFRKNVYISNSASLDKIKEAVKKFDAIGWDGKEQSYFFKYNPYNLADE
KYKNSTVSKEWAIPASAPRIRRQKGEDGYWKYDRVKVNEEPEKLLKVWNPVNPKATDIKQ
EIIKKEKAGDLQGEKELDGRLRNFWHSFIYLFNLVLELRNSPSLQIKIKAGEVIAVDEGV
DPIASPVKPFFTTPNPYIPSNLCWLAVENADANGAYNIARKGVMILKKIREHAKKDPEFK
KLPNLFISNAEWDEAARDWGKYAGTTALNLDH

FIG. 31H

Restriction Enzymes — Optimized

*Green: filtered sites; Blue: checked sites (not filtered); Red: kept sites.*

- BamHI(GGATCC) — 1(3805)
- EcoRI(GAATTC) — 1(3895)
- HindIII(AAGCTT) — 0
- BsmBI(CGTCTC) — 0
- BsaI(GGTCTC) — 0
- BbsI(GAAGAC) — 0
- AgeI(ACCGGT) — 0
- XhoI(CTCGAG) — 0
- NdeI(CATATG) — 1(3869)
- NotI(GCGGCCGC) — 0
- KpnI(GGTACC) — 1(1)
- BsrGI(TGTACA) — 0
- SpeI(ACTAGT) — 0
- XbaI(TCTAGA) — 0
- NheI(GCTAGC) — 0
- ARE — 0

CIS-Acting Elements — Optimized

- Splice(GGTAAG) — 0
- Splice(GGTGAT) — 0
- PolyA(AATAAA) — 0
- PolyA(ATTAAA) — 0
- Destabilizing(ATTTA) — 0
- PolyT(TTTTTT) — 0
- PolyA(AAAAAAA) — 0

Antiviral Motifs — Optimized

After Optimization
- Max Direct Repeat: Size:15 Distance:93 Frequency:2
- Max Inverted Repeat: Size: 12 Tm: 39.3 Start Positions: 842, 2867
- Max Dyad Repeat: None

```
ATGGAGGACCTGAACTTTGGCTTCAAGCGGGGCAGACAGAAGGTGGAGAAGCAGGTGTATCAGAAGTTTGAGAAG
ATGCTGATCGATAAGCTGAATTACCTGGTGGACAAGAATAAGAAGGCAAACGAGCTGGGAGGCCTGCTGAACGCA
TTCCAGCTGGCCAATAAGTTTGAGTCCTTCCAGAAGATGGGCAAGCAGAACGGCTTTATCTTCTACGTGCCCGCC
TGGAATACCTCTAAGACAGATCCTGCCACCGGCTTTATCGACTTCCTGAAGCCCGGCTATGAGAACCTGAATCAG
GCCAAGGATTTCTTTGAGAAGTTTGACTCTATCCGGCTGAACAGCAAGGCCGATTACTTTGAGTTCGCCTTTGAC
TTCAAGAATTTCACCGAGAAGGCCGATGGCCGGCAGAACCAAGTGGACAGTGTGCACCACAAACGAGGACAGATAT
GCCTGGAATAGGGCCCTGAACAATAACAGGGCGCAGCCAGGAGAAGTACGACATCACAGCCCGAGCTGAAGTCCCTG
TTCGATGGCAAGGTGGACTATAAGTCTGGCAAGGATCTGAAGCAGCAGATCGCCAGCCAGGAGTCCGCCGACTTC
TTTAAGGCCCTGATGAAGAACCTGTCCATCACCCTGTCTCTGGAGACACAATAACGGCGAGAAGGGCCGGTAATGAG
CAGGACTACATCCTGTCCCCTGTGGCCGATTCTAAGGGCCCGCTTCTTTGACTCCCGGAAGGCCGACGATGACATG
CCAAAGAATGCCGACGCCAACGGCGCCTATCACATCGCCCTGAAGGGCCTGTGGTGTCTGGAGCAGATCGCAAG
ACCGATGACCTGAAGAAGGTGAAGCTGGCCATCTCCAACAAGGAGTGGCTGGAGTTCGTGCAGACACTGAAGGGC
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC
```

FIG. 32G

MQTLFENFTNQYPVSKTLRFELIPQGKTKDFIEQKGLLKKDEDRAEKYKKVKNIIDEYHK
DFIEKSLNGLKLDGLEKYKTLYLKQEKDDKDKKAFDKEKENLRKQIANAFRNNEKFKTLP
AKELIKNDLMSFACEEDKKNVKEFEAPTTYFTGFHQNRANMYVADEKRTAIASRLIHENL
PKFIDNIKIFEKMKKEAPELLSPFNQTLKDMKDVIKGTTLEEIFSLDYPNKTLTQSGIDI
YNSVIGGRTPEEGKTKIKGLNEYINTDFNQKQTDKKKRQPKFKQLYKQILSDRQSLSFIA
EAFKNDTEILEAIEKFYVNELLHFSNEGKSTNVLDAIKNAVSNLESFNLTKMYFRSGASL
TDVSRKVPGEWSIINRALDNYYATTYPIKPREKSEKYEERKEKWLKQDFNVSLIQTAIDE
YDNETVKGKNSGKVIADYFAKFCDDKETDLIQKVNEGYIAVKDLLNTPCPENEKLGSNKD
QVKQIKAFMDSIMDIMHFVRPLSLKDTDKEKDETFYSLFTPLYDHLTQTIALYNKVRNYL
TQKPYSTEKIKLNFENSTLLGGWDLNKETDNTAIILRKDNLYYLGIMDKRHNRIFRNVPK
ADKKDFCYEKMVYKLLPGANKMLPKVFFSQSRIQEFTPSAKLLENYANETHKKGDNFNLN
HCHKLIDFFKDSINKHEDWKNFDFRFSATSTYADLSGFYHEVEHQGYKISFQSVADSFID
DLVNEGKLYLFQIYNKDFSPFSKGKPNLHTLYWKMLFDENNLKDVVYKLNGEAEVFYRKK
SIAEKNTTIHKANESIINKNPDNPKATSTPNYDIVKDKRYTIDKFQPHIPITMNFKAEGI
FNMNQRVNQFLKANPDINIIGIDRGERHLLYYALINQKGKILKQDTLNVIANEKQKVDYH
NLLDKKEGDRATARQEWGVIETIKELKEGYLSQVIHKLTDLMIENNAIIVMEDLNFGFKR
GRQKVEKQVYQKFEKMLIDKLNYLVDKNKKANELGGLLNAFQLANKFESPQKMGKQNGFI
FYVPAWNTSKTDPATGFIDFLKPRYENLNQAKDFFEKFDSIRLNSKADYFEFAFDFKNFT
EKADGGRTKWTVCTTNEDRYAWNRALNNNRGSQEKYDITAELKSLFDGKVDYKSGKDLKQ
QIASQESADFFKALMKNLSITLSLRHNNGEKGDNEQDYILSPVADSKGRFFDSRKADDDM
PKNADANGAYHIALKGLWCLEQISKTDDLKKVKLAISNKEWLEFVQTLKG

FIG. 32H

| Restriction Enzymes | Optimized |
|---|---|
| *Green: filtered sites; Blue: checked sites (not filtered); Red: kept sites.* | |
| BamHI(GGATCC) | 1(3976) |
| EcoRI(GAATTC) | 1(4068) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(4040) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

| CIS-Acting Elements | Optimized |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

| Antiviral Motifs | Optimized |
|---|---|
| | 0 |

FIG. 33D

After Optimization
  Max Direct Repeat:   Size:15 Distance:36 Frequency:2
  Max Inverted Repeat: None
  Max Dyad Repeat:     None

AGGGTGGCAGCAAGGCAGGCCTGGTCTGTGGTGGGCACAATCAAGGATCTGAAGCAGGGCTATCTGAGCCAGGTC
ATCCACGAGATCGTGGACCTGATGATCCACTACCAGGCCGTGGTGGTGCTGGAGAACCTGAATTTCGGCTTTAAG
AGCAAGAGGACCCGCATCGCCGAGAAGGCCGTGTACCAGCAGTTCGAGAAGATGCTGATCGATAAGCTGAATTGC
CTGGTGCTGAAGGACTATCCAGCAGAGAAAGTGGGAGGCGTGCTGAACCCATACCAGCTGACAGACCAGTTCACC
TCCTTTGCCAAGATGGGCACCCAGTCTGGCTTCCTGTTTTACGTGCCTGCCCCATATACATCTAAGATCGATCCC
CTGACCGGCTTCGTGGACCCCTTCGTGTGGAAAACCATCAAGAATCACGAGAGCCGCAAGCACTTCCTGGAGGGC
TTCGACTTTCTGCACTACGACGTGAAAACCGGCGACTTCATCCTGCACTTTAAGATGAACAGAAATCTGTCCTTC
CAGAGGGGCCTGCCCGGCTTTATGCCTGCATGGGATATCGTGTTCGAGAAGAACGAGACACAGTTTGACGCCAAG
GGCACCCCTTTCATCGCCGGCAAGGAGAATCGTGCCAGTGATCGAGAATCACAGATTCACCGGCAGATACCGGGAC
CTGTATCCTGCCAACGAGCTGATCGCCCTGCTGGAGGAGAAGGGCATCGTGTTCAGGGATGGCTCCAACATCCTG
CCAAAGCTGCTGGAGAATGACGATTCTCACGCCATCGACACCATGGTGGCCCCTGATCCGCAGCGTGCTGCAGATG
CGGAACTCCAATGCCGCCACAGGCGGACGACTATATCAACAGCCCCGTGCGCGATCTGAATGGCGTGTGCTTCGAC
TCCCGGTTTCAGAACCCAGAGTGGCCCATGGACGCCGATGCCAATGGCGCCTACCACATCGCCCTGAAGGGCCAG
CTGCTGCTGAATCACCTGAAGGAGAGCAAGGATCTGAAGCTGCAGAACGGCATCTCCAATCAGGACTGGCTGGCC
TACATCCAGGAGCTGCGCAAC
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 33G

MTQFEGPTNLYQVSKTLRFELIPQGKTLKHIQEQGFIEEDKARNDHYKELKPIIDRIYKT
YADQCLQLVQLDWENLSAAIDSYRKEKTEETRNALIEEQATYRNAIHDYFIGRTDNLTDA
INKRHAEIYKGLFKAELFNGKVLKQLGTVTTTEHENALLRSFDKPTTYFSGFYENRKNVF
SAEDISTAIPHRIVQDNPPKFKENCHIPTRLITAVPSLREHFENVKKAIGIPVSTSIEEV
FSPPPYNQLLTQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAEALFNELNSID
LTHIFISHKKLETISSALCDHWDTLRNALYERRISELTGKITKSAKEKVQRSLKHEDINL
QEIISAAGKELSEAPKQKTSEILSHAHAALDQPLPTTLKKQEEKEILKSQLDSLLGLYHL
LDWPAVDESNEVDPEFSARLTGIKLEMEPSLSFYNKARNYATKKPYSVEKFKLNFQMPTL
ASGWDVNKEKNNGAILFVKNGLYYLGIMPKQKGRYKALSFEPTEKTSEGFDKMYYDYFPD
AAKMIPKCSTQLKAVTAHFQTHTTPILLSNNPIEPLEITKEIYDLNNPEKEPKKFQTAYA
KKTGDQKGYREALCKWIDFTRDFLSKYTKTTSIDLSSLRPSSQYKDLGEYYAELNPLLYH
ISFQRIAEKEIMDAVETGKLYLFQIYNKDPAKGHHGKPNLHTLYWTGLFSPENLAKTSIK
LNGQAELFYRPKSRMKRMAHRLGEKMLNKKLKDQKTPIPDTLYQELYDYVNHRLSHDLSD
EARALLPNVITKEVSHEIIKDRRFTSDKFFFHVPITLNYQAANSPSKFNQRVNAYLKEHP
ETPIIGIDRGERNLIYITVIDSTGKILEQRSLNTIQQFDYQKKLDNREKERVAARQAWSV
VGTIKDLKQGYLSQVIHEIVDLMIHYQAVVVLENLNFGFKSKRTGIAEKAVYQQFEKMLI
DKLNCLVLKDYPAEKVGGVLNPYQLTDQPTSFAKMGTQSGFLPYVPAPYTSKIDPLTGFV
DPFVWKTIKNHESRKHFLEGFDFLHYDVKTGDFILHPKMNRNLSFQRGLPGFMPAWDIVP
EKNETQFDAKGTPFIAGKRIVPVIENHRFTGRYRDLYPANELIALLEEKGIVFRDGSNIL
PKLLENDDSHAIDTMVALIRSVLQMRNSNAATGEDYINSPVRDLNGVCFDSRFQNPEWPM
DADANGAYHIALKGQLLLNHLKESKDLKLQNGISNQDWLAYIQELRN

FIG. 33H

| Restriction Enzymes | Optimized |
|---|---|
| *Green: filtered sites; Blue: checked sites (not filtered); Red: kept sites. | |
| BamHI(GGATCC) | 1(3673) |
| EcoRI(GAATTC) | 1(3763) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(3737) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

| CIS-Acting Elements | Optimized |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

| Antiviral Motifs | Optimized |
|---|---|
| | 0 |

FIG. 34D

After Optimization
  Max Direct Repeat:   Size:17 Distance:1800 Frequency:2
  Max Inverted Repeat: None
  Max Dyad Repeat:     None

GAGCTGGGAGGCCCCTGAACGGCACTGCAGCTGACCTCTAAGTTCAAGAGCTTTAAGGAGCTGGGCAAGCAGTCC
GGCGTGATCTACTATGTGCCTGCCTACCTGACCTCTAAGATCGATCCAACCACAGGCTTCGCCAATCTGTTTTAT
ATGAAGTGTGAGAACGTGGAGAAGTCCAAGAGATTCTTTGACGGCTTTGATTTCATCAGGTTCAACGCCCTGGAG
AACGTGTTCGAGTTCGGCTTTGACTACCGGAGCTTCACCCAGAGGGCCTGCGGCATCAATTCCAAGTGGACCTTG
TGCACCAACGGCGACGGCATCATCAAGTATCGGAATCCAGATAAGAACAATATGTTCGACGAGAAGGTGGTGGTG
GTGACCGATGAGATGAAGAACCTGTTTGAGCAGTACAAGATCCCCTATGAGGATGGCAGAAATGTGAAGGACATG
ATCATCAGCAACGACGGAGGCCGAGTTCTACCGGAGACTGTATAGGCTGCTGCAGCAGACCCTGCAGATGAGAAAC
AGCACCTCCGACGGCACAAGGGAATTACATCATCTCCCCTGTGAAGAATAAGAGAGAGGCCTACTTCAACAGCGAG
CTGTCCGACGGCTCTGTGCCAAAGGACGCCGATGCCAACGGCGGCCTACAATATCGCCAGAAAGGGCCTGTGGGTG
CTGGAGCAGATCAGGCAGAAGAGCGAGGGCGAGAAGATCAATCTGGCCATGACCAACGCCGAGTGGCTGGAGTAT
GCCCAGACACACCTGCTG
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 34G

MYYESLTKQYPVSKTIRNELIPIGKTLDNIRQNNILESDVKRKQNYEHVKGILDEYHKQL
INEALDNCTLPSLKIAAEIYLKNQKEVSDREDFNKTQDLLRKEVVEKLKAHENPTKIGKK
DILDLLEKLPSISEDDYNALESFRNFYTYFTSYNKVRENLYSDKEKSSTVAYRLINENFP
KPLDNVKSYRFVKTAGILADGLGEEEQDSLPIVETFNKTLTQDGIDTYNSQVGKINSSIN
LYNQKNQKANGPRKIPKMKMLYKQILSDREESPIDEPQSDEVLIDNVESYGSVLIESLKS
SKVSAFPDALRESKGKNVYVKNDLAKTAMSNIVFENWRTFDDLLNQEYDLANENKKKDDK
YFEKRQKELKKNKSYSLEHLCNLSEDSCNLIENYIHQISDDIENIIINNETFLRIVINEH
DRSRKLAKNRKAVKAIKDFLDSIKVLERELKLINSSGQELEKDLIVYSAHEELLVELKQV
DSLYNMTRNYLTKKPFSTEKVKLNFNRSTLLNGWDRNKETDNLGVLLLKDGKYYLGIMNT
SANKAFVNPFVAKTEKVFKKVDYKLLPVPNQMLPKVFFAKSNIDFYNPSSEIYSNYKKGT
HKKGNMPSLEDCHNLIDFFKESISKHEDWSKFGFKFSDTASYNDISEFYREVEKQGYKLT
YTDIDETYINDLIERNELYLFQIYNKDPSMYSKGKLNLHTLYFMMLFDQRNIDDVVYKLN
GEAEVFYRPASISEDELIIHKAGEEIKNKNPNRARTKETSTFSYDIVKDKRYSKDKFTLH
IPITMNPGVDEVKRFNDAVNSAIRIDENVNVIGIDRGERNLLYVVVIDSKGNILEQISLN
SIINKEYDIETDYHALLDEREGGRDKARKDWNTVENIRDLKAGYLSQVVNVVAKLVLKYN
AIICLEDLNPGFKRGRQKVEKQVYQKFEKMLIDKLNYLVIDKSREQTSPKELGGALNALQ
LTSKFKSFKELGKQSGVIYYVPAYLTSKIDPTTGFANLFYMKCENVEKSKRFFDGFDFIR
FNALENVFEPGPDYRSPTQRACGINSKWTVCTNGERIIKYRNPDKNNMFDEKVVVVTDEM
KNLFEQYKIPYEDGRNVKDMIISNEEAEFYRRLYRLLQQTLQMRNSTSDGTRDYIISPVK
NKREAYFNSELSDGSVPKDADANGAYNIARKGLWVLEQIRQKSEGEKINLAMTNAEWLEY
AQTHLL

FIG. 34H

Restriction Enzymes — Optimized

*Green: filtered sites; Blue: checked sites (not filtered); Red: kept sites.*

| | |
|---|---|
| BamHI(GGATCC) | 1(3789) |
| EcoRI(GAATTC) | 1(3859) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(3833) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

CIS-Acting Elements — Optimized

| | |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

Antiviral Motifs — Optimized

After Optimization
 Max Direct Repeat:   Size:13 Distance:1506 Frequency:2
 Max Inverted Repeat: None
 Max Dyad Repeat:     None

```
AAGCCGGGGCCGGTTCAAGGTGGAGAAGCAGATCTATCAGAAGTTCGAGAATATGCTGATCGATAAGATGAACTAC
CTGGTGTTTAAGGACGGCACCTGATGAGTCCCCAGGAGGCCGTGCTGAATGCCTACCAGCTGACAAACCCACTGGAG
TCTTTCGCCAAGCTGGGCAAGCAGACCGGCATCCTGTTTTACGTGCCAGCCGCCTATACATCCAAGATCGACCCC
ACCACAGGCTTTCGTGAATCTGTTTAACACCTCCTCTAAGACAAACGCCCAGGAGCCGGAAGGAGTTCCTGCAGAAG
TTTGAGAGCATCTCCTATTCTGCCAAGGATGGCGGGCATCTTTGCCTTCGCCTTTGACTACAGAAAGTTCGGCACC
AGCAAGACAGATCACAAGAACGTGTGGACCGCCTATACAAACGGCGAGAGGATGCGCTACATCAAGGAGAAGAAG
CGGAATGAGCTGTTTGACCCCTTCTAAGGAGATCAAGGAGGCCCTGACCAGCTCCGGCATCAAGTACGATGGCGGC
CAGAACATCCTGCCAGACATCCTGAGGAGCAACAATAACGGCCTGATCTACACAATGTATTCTAGCTTCATCGCC
GCCATCCAGATGCGCGTGTACGACGGCAAGGAGGATTATATCATCAGCCCCATCAAGAACTCCAAGGGCGAGTTC
TTTAGGACCGACCCCAAGAGCGCGGAGCTGCCTATCGACGCCGATGCCAATGGCGCCTACAACATCGCCCTGAGG
GGAGAGCTGACAATGACGGCAATCGCAGAGAAGTTCGACCCCTGATAGCCGAGAAGATGGCCAAGCTGGAGCTGAAG
CACAAGGATTGGTTCGAGTTTATGCAGACCAGAGGCGAC
AAAAGGCCGGCGGCCACGAAAAAGGCCGGCCAGGCAAAAAAGAAAAAGGGGATCCTACCCATACGATGTTCCAGAT
TACGCTTATCCCTACGACGTGCCTGATTATGCATACCCATATGATGTCCCCGACTATGCCTAAGAATTC
```

FIG. 35G

MNNYDEFTKLYPIQKTIRFELKPQGRTMEHLETFNFFEEDRDRAEKYKILKEAIDEYHKK
FIDEHLTNMSLDWNSLKQISEKYYKSREEKDKKVFLSBQKRMRQEIVSEFKKDDRFKDLF
SKKLPSELLKEEIYKKGNHQEIDALKSFDKPSGYPIGLHENRKNMYSDGDEITAISNRIV
NENFPKFLDNLQKYQEARKKYPEWIIKAESALVAHNIKMDEVFSLEYFNKVLNQBGIQRY
NLALGGYVTKSGEKMMGLNDALNLAHQSEKSSKGRIHMTPLFKQILSEKESFSYIPDVFT
EDSQLLPSIGGFPAQIENDKDGNIFDRALELISSYAEYDTERIYIRQADINRVSNVIFGE
WGTLGGLMREYKADSINDINLERTCKKVDKWLDSKEFALSDVLEAIKRTGNNDAFNEYIS
KMRTAREKIDAARKEMKFISEKISGDEESIHIIKTLLDSVQQFLHFFNLFKARQDIPLDG
AFYAEFDEVHSKLFAIVPLYNKVRNYLTKNNLNTKKIKLNFKNPTLANGWDQNKVYDYAS
LIFLRDGNYYLGIINPKRKKNIKFEQGSGNGPPYRKMVYKQIPGPNKNLPRVFLTSTKGK
KEYKPSKEIIEGYEADKHIRGDKFDLDFCHKLIDFFKESIEKHKDWSKFNPYFSPTESYG
DISEFYLDVEKQGYRMHFENISAETIDEYVEKGDLFLFQIYNKDFVKAATGKKDMHTIYW
NAAFSPENLQDVVVKLNGEAELFYRDKSDIKEIVHREGEILVNRTYNGRTPVPDKIHKKL
TDYHNGRTKDLGEAKEYLDKVRYFKAHYDITKDRRYLNDKIYFHVPLTLNFKANGKKNLN
KMVIEKFLSDEKAHIIGIDRGERNLLYYSIIDRSGKIIDQQSLNVIDGFDYREKLNQREI
EMKDARQSWNAIGKIKDLKEGYLSKAVHEITKMAIQYNAIVVMEELNYGFKRGRFKVEKQ
IYQKFENMLIDKMNYLVFKDAPDESPGGVLNAYQLTNPLESFAKLGKQTGILFYVPAAYT
SKIDPTTGFVNLFNTSSKTNAQERKEFLQKFESISYSAKDGGIFAFAFDYRKFGTSKTDH
KNVWTAYTNGERMRYIKEKKRNELFDPSKEIKEALTSSGIKYDGGQNILPDILRSNNNGL
IYTMYSSFIAAIQMRVYDGKEDYIISPIKNSKGEFFRTDPKRRELPIDADANGAYNIALR
GELTMRAIAEKFDPDSEKMAKLELKHKDWFEFMQTRGD

FIG. 35H

| Restriction Enzymes | Optimized |
|---|---|
| *Green: filtered sites; Blue: checked sites (not filtered); Red: kept sites.* | |
| BamHI(GGATCC) | 1(3901) |
| EcoRI(GAATTC) | 1(3991) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(3965) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

| CIS-Acting Elements | Optimized |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

| Antiviral Motifs | Optimized |
|---|---|
| | 0 |

FIG. 36D

After Optimization
Max Direct Repeat: Size:14 Distance:894 Frequency:2
Max Inverted Repeat: None
Max Dyad Repeat: Size: 13 Tm: 40.1 Start Positions: 2322, 3831

ATCGCCATGCTGATCGTGGAGTACAACGCCATCATCGCCATGGAGGACCTGAATTATGGCTTTAAGAGGGGCCGC
TTCAAGGTGGAGCGGCAGGTGTACCAGAAGTTTGAGGGCATGCTGATCAATAAGCTGAACTATTTCGGCCAGCAAG
GAGAAGTCCGTGGACGAGCCAGGAGGCCTGCTGAAGGGCTATCAGCTGACCTACGTGCCCGATAATATCAAGAAC
CTGGGCAAGCAGTGGGGCGTGATCTTTTACGTGCCTGCCGCCTTCACCAGCAAGATCGACCCGTCCACAGGCTTT
ATCTCTGCCTTCAACTTTAAGTCTATCAGCACAAATGCCTCTCGGAAGCAGTTCTTTATGCAGTTTGACGAGATC
AGATACTGTGCCGAGAAGGATATGTTCAGCTTTGGCTTCGACTACAACAACTTCGATACCTACAACATCACAATG
GGCAAGACACAGTGGACGGTGTATACAAACGGCGAGAGACTGCAGTCTGAGTTCAACAATGCCAGGCGCACCGGC
AAGACAAAGAGCATCAATCTGACAGAGACAATCAAGCTGCTGCTGGAGGACAATGAGATCAACTACGCCGACGGC
CACGATATCAGGATCGATATGGAGAAGATGGACGAGGATAAGAAGAGCGGAGTTCTTTGCCCAGCTGCTGAGCCTG
TATAAGCTGACCGTGCAGATGGGCAATTCCTATACAGAGGCCGAGGAGCAGGAGAACGGCATCTCTTACGACAAG
ATCATCAGCCCTGTGATCAATGATGAGGGCGAGTTCTTTGACTCCGATAACTATAAGGAGTCTGACCGATAAGGAG
TGCAAGATGCCAAAGGACGCCGATGCCAACGGCGCCTACTGTATCGCCCTGAAGGGCCTGTATGAGTGCTGAAG
ATCAAGAGCGAGTGGACCGAGGACGGCTTTGATAGGAATTGCCTGAAGCTGCCACACGGCAGAGTGGCTGGACTTTC
ATCCAGAACAAGCGGTACGAG

AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 36G

MNGNRSIVYREFVGVIPVAKTLRNELRPVGHTQEHIIQNGLIQEDELRQEKSTELKNIMD
DYYREYIDKSLSGVTDLDFTLLFELMNLVQSSPSKDNKKALEKEQSKMREQICTHLQSDS
NYKNIFNAKLLKEILPDFIKNYNQYDVKDKAGKLETLALFNGFSTYFTDFFEKRKNVPTK
EAVSTSIAYRIVHENSLIFLANMTSYKKISEKALDEIEVIEKNNQDKMGDWELNQIFNPD
FYNMVLIQSGIDPYNEICGVVNAHMNLYCQQTKNNYNLFKMRKLHKQILAYTSTSFEVPK
MFEDDMSVYNAVNAFIDETEKGNIIGKLKDIVNKYDELDEKRIYISKDFYETLSCFMSGN
WNLITGCVENFYDENIHAKGKSKEEKVKKAVKEDKYKSINDVNDLVEKYIDEKERNEFKN
SNAKQYIREISNIITDTETAHLEYDDHISLIESEEKADEMKKRLDMYMNMYHWAKAFIVD
EVLDRDEMPYSDIDDIYNILENIVPLYNRVRNYVTQKPYNSKKIKLNFQSPTLANGWSQS
KEFDNNAIILIRDNKYYLAIFNAKNKPDKKIIQGNSDKKNDNDYKKMVYNLLPGANKMLP
KVFLSKKGIETFKPSDYIISGYNAHKHIKTSENFDISFCRDLIDYFKNSIEKHAEWRKYE
FKFSATDSYSDISEFYREVEMQGYRIDWTYISEADINKLDEEGKIYLFQIYNKDFAENST
GKENLHTMYFKNIFSEENLKDIIIKLNGQAELFYRRASVKNPVKHKKDSVLVNKTYKNQL
DNGDVVRIPIPDDIYNEIYKMYNGYIKESDLSEAAKEYLDKVEVRTAQKDIVKDYRYTVD
KYFIHTPITINYKVTARNNVNDMVVKYIAQNDDIHVIGIDRGERNLIYISVIDSHGNIVK
QKSYNILNNYDYKKKLVEKEKTREYARKNWKSIGNIKELKEGYISGVVHEIAMLIVEYNA
IIAMEDLNYGFKRGRFKVERQVYQKFESMLINKLNYFASKEKSVDEPGGLLKGYQLTYVP
DNIKNLGKQCGVIFYVPAAFTSKIDPSTGFISAFNFKSISTNASRKQFFMQFDEIRYCAE
KDMFSFGFDYNNFDTYNITMGKTQWTVYTNGERLQSEPNNARRTGKTKSINLTETIKLLL
EDNEINYADGHDIRIDMEKMDEDKKSEFFAQLLSLYKLTVQMRNSYTEAEEQENGISYDK
IISPVINDEGEFFDSDNYKESDDKECKMPKDADANGAYCIALKGLYEVLKIKSEWTEDGF
DRNCLKLPHAEWLDFIQNKRYE

FIG. 36H

| Restriction Enzymes | Optimized |
|---|---|

*Green: filtered sites, Blue: checked sites (not filtered); Red: kept sites.

| | |
|---|---|
| BamHI(GGATCC) | 1(4174) |
| EcoRI(GAATTC) | 1(4264) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(4238) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

| CIS-Acting Elements | Optimized |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

| Antiviral Motifs | Optimized |
|---|---|
| | 0 |

FIG. 37D

After Optimization
    Max Direct Repeat:    Size:14 Distance:525 Frequency:2
    Max Inverted Repeat:  None
    Max Dyad Repeat:      None

CCAATCACCATGAACTTTGGCGTGCAGGGCATGACAATCAAGGAGTTCAATAAGAAGGTGAACCAGTCTATCCAG
CAGTATGACGAGGTGAACGTGATCGGCATCGATCGGGGCGAGAGACACCTGCTGTACCTGACCGTGATCAATAGC
AAGGGCGAGATCCTGGAGCAGTGTTCCCTGAACGACATCACCACAGCCTCTGCCAATGCCACACAGATGACCACA
CCTTACCACAAGATCCTGGATAAGAGGGAGATCGAGCGCCTGAACGCCCGGGTGGGATGGGGCGAGATCGAGACA
ATCAAGGAGCTGAAGTCTGGCTATCTGAGCCACGTGGTGCACCAGATCAGCCAGCTGATGCTGAAGTACAACGCC
ATCGTGGTGCTGGAGGACCTGAATTTCGGCTTTAAGAGGGGCCGGCTTTAAGGTGGAGAAGCAGATCTATCAGAAC
TTCGAGAATGCCCTGATCAAGAAGCTGAACCACCTGGTGCTGAAGGACAAGGCCGACGATGAGATCGGCTCTTAC
AAGAATGCCCTGCAGCTGACCAACCAATTTCACAGATCTGAAGAGCATCGGCAAGCAGACCGGCTTCCTGTTTTAT
GTGCCCGCCTGGAACACCTCTAAGATCGACCCTGAGACAGGCTTTGTGGATCTGCTGAAGCCAAGATACGAGAAC
ATCGCCCAGAGCCAGGCCTTCTTTGGCAAGTTCGACAAGATCTGCTATAATGCCGACAAGGATTACTTCGAGTTT
CACATCGACTACGCCAAGTTTACCGATAAGGCCAAGAATAGCCGCCAGATCTGGACAATCTGTTCCCACGGCGAC
AAGCGGTACGTGTACGATAAGACAGCCAACCAGAATAAGGGCGCCGCCAAGGGCATCAACGTGAATGATGAGCTG
AAGTCCCTGTTCGCCCCCCACCACATCAACGAGAAGCAGCCCAACCTGGTCATTGACATCTGCCAGAACAATGAT
AAGGAGTTTCACAAGTCTCTGATGTACCTGCTGAAAACCCTGCTGGCCCTGCCGTACAGCAACGCCTCCTCTGAC
GAGGATTTCATCCTGTCCCCCGTGGCAAACGACGAGGGCTGTTCTTTAATAGCGCCCTGGCCGACGATACACAG
CCTCAGAATGCCGATGCCAACGGCGGCCTACCACATCGCCCTGAAGGGCCTGTGGCTGCTGAATGAGCTGAAGAAC
TCCGACGATCTGAACAAGGTGAAGCTGGCCATCGACAATCAGACCTGGCTGAATTTCGCCCAGAACAGG
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 37G

MLPQDPTHLYPLSKTVRPELKPIDRTLEHIHAKNPLSQDETMADMHQKVKVILDDYHRDF
IADMMGEVKLTKLAEFYDVYLKFRKNPKDDELQKQLKDLQAVLRKEIVKPIGNGGKYKAG
YDRLFGAKLPKDGKELGDLAKFVIAQEGESSPKLAHLAHFEKPSTYFTGFHDNRKNMYSD
EDKHTAIAYRLIHENLPRFIDNLQILTTIKQEHSALYDQIINELTASGLDVSLASHLDGY
HKLLTQEGITAYNTLLGGISGEAGSPKIQGINELINSHHNQHCHKSERIAKLRPLHKQIL
SDGMSVSFLPSKFADDSEMCQAVNEFYRHYADVFAKVQSLFDGFDDHQKDGIYVEHKNLN
ELSKQAFGDFALLGRVLDGYYVDVVNPEFNERFAKAKTDNAKAKLTKEKDKFIKGVHSLA
SLEQAIEHYTARHDDESVQAGKLGQYFKHGLAGVDNPIQKIHNNHSTIKGFLERERPAGE
RALPKIKSGKNPEMTQLRQLKELLDNALNVAHFAKLLTTKTTLDNQDGNFYGEFGVLYDE
LAKIPTLYNKVRDYLSQKPFSTEKYKLNFGNPTLLNGWDLNKEKDNFGVILQKDGCYYLA
LLDKAHKKVFDNAPNTGKSIYQKMIYKYLEVRKQFPKVFFSKEAIAINYHPSKELVEIKD
KGRQRSDDERLKLYRPILECLKIHPKYDKKFEGAIGDIQLFKKDKKGREVPISEKDLFDK
INGIPSSKPKLEMEDPPIGEPKRYNPSQDLVDQYNIYKKIDSNDNRKKENPYNNHPKPKK
DLVRYYYESMCKHEEWEESFEFSKKLQDIGCYVDVNELPTEIETRRLNYKISPCNINADY
IDELVEQGQLYLPQIYNKDFSPKAHGKPNLHTLYFKALFSEDNLADPIYKLNGEAQIFYR
KASLDMNETTIHRAGEVLENKNPDNPKKRQFVYDIIKDKRYTQDKFMLHVPITMNFGVQG
MTIKEFNKKVNQSIQQYDEVNVIGIDRGERHLLYLTVINSKGEILEQCSLNDITTASANG
TQMTTPYHKILDKREIERLNARVGWGEIETIKELKSGYLSHVVHQISQLMLKYNAIVVLE
DLNFGFKRGRFKVEKQIYQNFENALIKKLNHLVLKDKADDEIGSYKNALQLTNNFTDLKS
IGKQTGFLFYVPAWNTSKIDPETGFVDLLKPRYENIAQSQAFFGKFDKICYNADKDYFEF
HIDYAKFTDKAKNSRQIWTICSHGDKRYVYDKTANQNKGAAKGINVNDELKSLFARHHIN
EKQPNLVMDICQNNDKEPHKSLMYLLKTLLALRYSNASSDEDFILSPVANDEGVFFNSAL
ADDTQPQNADANGAYHIALKGLWLLNELKNSDDLNKVKLAIDNQTWLNFAQNR

FIG. 37H

Restriction Enzymes — Optimized

*Green: filtered sites; Blue: checked sites (not filtered); Red: kept sites.*

- BamHI(GGATCC) — 1(3844)
- EcoRI(GAATTC) — 1(3934)
- HindIII(AAGCTT) — 0
- BsmBI(CGTCTC) — 0
- BsaI(GGTCTC) — 0
- BbsI(GAAGAC) — 0
- AgeI(ACCGGT) — 0
- XhoI(CTCGAG) — 0
- NdeI(CATATG) — 1(3908)
- NotI(GCGGCCGC) — 0
- KpnI(GGTACC) — 1(1)
- BsrGI(TGTACA) — 0
- SpeI(ACTAGT) — 0
- XbaI(TCTAGA) — 0
- NheI(GCTAGC) — 0
- ARE — 0

CIS-Acting Elements — Optimized

- Splice(GGTAAG) — 0
- Splice(GGTGAT) — 0
- PolyA(AATAAA) — 0
- PolyA(ATTAAA) — 0
- Destabilizing(ATTTA) — 0
- PolyT(TTTTTT) — 0
- PolyA(AAAAAAA) — 0

Antiviral Motifs — Optimized

After Optimization

- Max Direct Repeat: Size:14 Distance:111 Frequency:2
- Max Inverted Repeat: None
- Max Dyad Repeat: Size: 13 Tm: 35.4 Start Positions: 1027, 221

```
AGCAAGCTGATGGTGGAGAACAATGCCATCGTGGTGCTGGAGGACCTGAACATCGGCTTTAAGCGGGGCAGACAG
AACGTGGAGCGGCGGTGTACCAGAAGTTCGAGAAGATGCTGATCGATAGCTGAACTTTCTGGTGTTCAAGGAG
AATAAGCCAACCGAGCCAGGAGGCGTGCTGAAGGCCTATCAGCTGACAGACGAGTTTCAGTCTTTCCGAGAAGCTG
AGCAAGCAGACCGGCTTTCTGTTCTACGTGCCAAGCTGGAACACCTCCAAGATCGACCCCAGAACAGGCTTTATC
GATTTCCTGCACCCTGCCTACGAGAATATCGAGAAGGCCAAGCAGTGGATCAACAAGTTTGATTCCATCAGGTTC
AATTCTAAGATGGACTGGTTTGAGTTCACCGCCGATACACGCAAGTTTTCCGAGAACCTGATGCTGGGCAAGAAT
CGGGTGTGGGTCATCTGCACCACAAATGTGGAGCGGTACTTCACCAGCAAGACCGCCAACAGCTCCATCCAGTAC
AATAGCATCCAGATCACCGAGAAGCTGAAGGAGCTGTTTGTGGACATCCCTTTCAGCAACGGCCAGGATCTGAAG
CCAGAGATCCTGAGGAAGAATGACGCCGTGTTCTTTAAGAGCCTGCTGTTTACATCAAGACCACACTGTCCCTG
CGCCAGAACAATGGCAAGAAGGGCGAGGAGGAGAAGGACTTCATCCTGAGCCCAGTGGTGGATTCCAAGGGCCGG
TTCTTTAACTCTCTGGAGGCCAGCGACGATGAGCCCAAGGACGCCGATGCCAATGGCGCCTACCACATCGCCCTG
AAGGGCCTGATGAACCTGCTGGTGCTGAATGAGACAAAGGAGGAGAACCTGAGCAGACCAAAGTGGAAGATCAAG
AATAAGGACTGGCTGGAGTTCGTGTGGGAGAGGAACCGC
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC
```

FIG. 38G

MEDYSGFVNIYSIQKTLRFELKPVGKTLEHIEKKGFLKKDKIRAEDYKAVKKIIDKYHRA
YIEEVFDSVLHQKKKKDKTRFSTQFIKEIKEFSELYYKTEKNIPDKERLEALSEKLRKML
VGAPKGEFSEEVAEKYKNLFSKELIRNEIEKPCETDEERKQVSNFKSFTTYFTGFHSNRQ
NIYSDEKKSTAIGYRIIHQNLPKFLDNLKIIESIQRRFKDFPWSDLKKNLKKIDKNIKLT
EYPSIDGFVNVLNQKGIDAYNTILGGKSEESGEKIQGLNEYINLYRQKNNIDRKNLPNVK
ILPKQILGDRETKSFIPEAPPDDQSVLNSITEPAKYLKLDKKKKSIIAELKKPLSSFNRY
ELDGIYLANDNSLASISTPLPDDWSPIKKSVSPKYDESVGDPKKKIKSPLKYEKEKEKWL
KQKYYTISFLNDAIESYSKSQDEKRVKIRLEAYPAEPKSKDDAKKQPDLLEHIEEAYAIV
EPLLGAEYPRDRNLKADKKEVGKIKDFLDSIKSLQPFLKPLLSAEIFDEKDLGFYNQLEG
YYEEIDSIGHLYNKVRNYLTGKIYSKEKPKLNFENSTLLKGWDENREVANLCVIPREDQK
YYLGVMDKENNTILSDIPKVKPNELFYEKMVYKLIPTPHMQLPRIIFSSDNLSIYNPSKS
ILKIREAKSFKEGKNFKLKDCHKFIDFYKESISKNEDWSRFDFKFSKTSSYENISEFYRE
VERQGYNLDFKKVSKFYIDSLVEDGKLYLPQIYNKDFSIFSKGKPNLHTIYFRSLFSKEN
LKDVCLKLNGEAEMPFRKKSINYDEKKKREGHHPELFEKLYPILKDKRYSEDKFQFHLP
ISLNFKSKERLNFNLKVNEFLKRNKDINIIGIDRGERNLLYLVMINQKGEILKQTLLDSM
QSGKGRPEINYKEKLQEKEIERDKARKSWGTVENIKELKEGYLSIVIHQISKLMVENNAI
VVLEDLNIGFKRGRQKVERQVYQKFEKMLIDKLNFLVFKENKPTEPGGVLKAYQLTDEFQ
SFEKLSKQTGFLFYVPSWNTSKIDPRTGFIDPLHPAYENIEKAKQWINKFDSIRFNSKMD
WFEFTADTRKFSENLMLGKNRVWVICTTNVERYFTSKTANSSIQYNSIQITEKLKELFVD
IPFSNGQDLKPEILRKNDAVFFKSLLFYIKTTLSLRQNNGKKGEEEKDFILSPVVDSKGR
FFNSLEASDDEPKDADANGAYHIALKGLMNLLVLNETKEENLSRPKWKIKNKDWLEFVWE
RNR

FIG. 38H

Restriction Enzymes                                                     Optimized

*Green: filtered sites; Blue: checked sites (not filtered); Red: kept sites.*

BamHI(GGATCC)                                     1(3739)
    EcoRI(GAATTC)                                       1(3829)
    HindIII(AAGCTT)                                     0
    BsmBI(CGTCTC)                                     0
    BsaI(GGTCTC)                                         0
    BbsI(GAAGAC)                                         0
    AgeI(ACCGGT)                                       0
    XhoI(CTCGAG)                                         0
    NdeI(CATATG)                                         1(3803)
    NotI(GCGGCCGC)                                   0
    KpnI(GGTACC)                                       1(1)
    BsrGI(TGTACA)                                       0
    SpeI(ACTAGT)                                         0
    XbaI(TCTAGA)                                         0
    NheI(GCTAGC)                                       0
    ARE                                                         0

CIS-Acting Elements                                               Optimized
    Splice(GGTAAG)                                     0
    Splice(GGTGAT)                                     0
    PolyA(AATAAA)                                     0
    PolyA(ATTAAA)                                     0
    Destabilizing(ATTTA)                             0
    PolyT(TTTTTT)                                       0
    PolyA(AAAAAAA)                                 0

Antiviral Motifs                                                     Optimized
                                                                              0

FIG. 39D

After Optimization
    Max Direct Repeat:     Size:14 Distance:150 Frequency:2
    Max Inverted Repeat: None
    Max Dyad Repeat:     None

```
ATCGATAAGCTGAACTACATGGTGGACAAGAAGTCTAATCCTTGTGCAACAGGCGGCGCCCTGAAGGGCTATCAG
ATCGCCAATAAGTTCGAGGAGCTTTAAGTCCATGTCTACCCAGAACGGCTTCATCTTTTACATCCCTGCCTGGCTG
ACATCCAAGATCGATCCATCTACCGGCTTTGTGAACCTGCTGAAAACCAAGTATACCAGCATCGCCGATTCCAAG
AAGTTCATCAGCTCCTTTGACAGGATCATGTACGTGCCCGAGGAGGATCTGTTCGAGTTTGCCCTGGACTATAAG
AACTTCTCTCGCACAGACGCCGATTACATCAAGAAGTGGAAGCTGTACTCCTACGGCAACCGGATCAGAATCTTC
CGGAATCCTAAGAAGAACAACGTGTTCGACTGGGAGGAGTGTGCCTGACCAGCGCCTATAAGGAGCTGTTCAAC
AAGTACGGCATCAATTATCAGCAGGGCGATATCAGAGCCCTGCTGTGCGAGCAGTCCGACAAGGCCTTCTACTCT
AGCTTTATGGCCCTGATGAGCCTGATGCTGCAGATGCGGAACAGCATCACAGGCCGCACCGACGTGGATTTTCTG
ATCAGCCCTGTGAAGAACTCCGACGGCATCTTCTACGATAGCCGGAACTATGAGGCCCAGGAGAATGCCATCCTG
CCAAAGAACGCCGACGCCAATGGCGCCTATAACATCGCCAGAAAGGTGCTGTGGGCCATCGGCCAGTTCAAGAAG
GCCGAGGACGAGAAGCTGGATAAGGTGAAGATCGCCATCTCTAACAAGGAGTGGCTGGAGTACGCCCAGACCAGC
GTGAAGCAC
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC
```

FIG. 39G

```
MSKLEKPTNCYSLSKTLRFKAIPVGKTQENIDNKRLLVEDEKRAEDYKGVKKLLDRYYLS
PINDVLHSIKLKNLNNYISLPRKKTRTEKENKELENLEINLRKEIAKAFKGNEGYKSLFK
KDIIETILPEFLDDKDEIALVNSFNGFTTAFTGFFDNRENMFSEEAKSTSIAFRCINENL
TRYISNMDIFEKVDAIFDKHEVQEIKEKILNSDYDVEDFFEGEFFNFVLTQEGIDVYNAI
IGGFVTESGEKIKGLNEYINLYNQKTKQKLPKFKPLYKQVLSDRESLSFYGEGYTSDEEV
LEVFRNTLNKNSEIFSSIKKLEKLFKNFDEYSSAGIFVKNGPAISTISKDIFGEWNVIRD
KWNAEYDDIHLKKAVVTEKYEDDRRKSFKKIGSFSLEQLQEYADADLSVVEKLREIIIQ
KVDEIYKVYGSSEKLFDADFVLEKSLKKNDAVVAIMKDLLDSVKSFENYIKAFFGEGKET
NRDESFYGDFVLAYDILLKVDHIYDAIRNYVTQKPYSKDKFKLYPQNPQFMGGWDKDKET
DYRATILRYGSKYYLAIMDKKYAKCLQKIDKDDVNGNYEKINYKLLPGPNKMLPKVPFSK
KWMAYYNPSEDIQKIYKNGTFKKGDMFNLNDCHKLIDFFKDSISRYPKWSNAYDFNFSET
EKYKDIAGFYREVEEQGYKVSFESASKKEVDKLVEEGKLYMFQIYNKDFSDKSHGTPNLH
TMYFKLLFDENNHGQIRLSGGAELPMRRASLKKEELVVHPANSPIANKNPDNPKKTTTLS
YDVYKDKRFSEDQYELHIPIAINKCPKNIFKINTEVRVLLKHDDNPYVIGIDRGERNLLY
IVVVDGKGNIVEQYSLNEIINNFNGIRIKTDYHSLLDKKEKERFEARQNWTSIENIKELK
AGYISQVVHKICELVEKYDAVIALEDLNSGFKNSRVKVEKQVYQKFEKMLIDKLNYMVDK
KSNPCATGGALKGYQITNKFESFKSMSTQNGFIFYIPAWLTSKIDPSTGFVNLLKTKYTS
IADSKKFISSFDRIMYVPEEDLFEFALDYKNFSRTDADYIKKWKLYSYGNRIRIFRNPKK
NNVFDWEEVCLTSAYKELFNKYGINYQQGDIRALLCEQSDKAFYSSFMALMSLMLQMRNS
ITGRTDVDFLISPVKNSDGIFYDSRNYEAQENAILPKNADANGAYNIARKVLWAIGQFKK
AEDEKLDKVKIAISNKEWLEYAQTSVKH
```

FIG. 39H

Restriction Enzymes — Optimized

*Green: filtered sites; Blue: checked sites (not filtered); Red: kept sites.*

- BamHI(GGATCC) — 1(3835)
- EcoRI(GAATTC) — 1(3925)
- HindIII(AAGCTT) — 0
- BsmBI(CGTCTC) — 0
- BsaI(GGTCTC) — 0
- BbsI(GAAGAC) — 0
- AgeI(ACCGGT) — 0
- XhoI(CTCGAG) — 0
- NdeI(CATATG) — 1(3899)
- NotI(GCGGCCGC) — 0
- KpnI(GGTACC) — 1(1)
- BsrGI(TGTACA) — 0
- SpeI(ACTAGT) — 0
- XbaI(TCTAGA) — 0
- NheI(GCTAGC) — 0
- ARE — 0

CIS-Acting Elements — Optimized

- Splice(GGTAAG) — 0
- Splice(GGTGAT) — 0
- PolyA(AATAAA) — 0
- PolyA(ATTAAA) — 0
- Destabilizing(ATTTA) — 0
- PolyT(TTTTTT) — 0
- PolyA(AAAAAAA) — 0

Antiviral Motifs — Optimized

After Optimization

Max Direct Repeat: Size:13 Distance:2043 Frequency:2
Max Inverted Repeat: Size: 13 Tm: 41.3 Start Positions: 1469, 2693;
Max Dyad Repeat: None

GAGCTGATGGTGGCCTATAAGGCCGTGGTGGCCCTGGGAGGACCTGAACATGGGGCTTCAAGCGGGGCAGACAGAAG
GTGGAGAGCAGCGTGTACCAGCAGTTTGAGAAGCAGCTGATCGACAAGCTGAATTATCTGGTGGATAAGAAGAAG
CGGCCCGGAGGACATCGGAGGCCTGCTGAGAGCCTACCAGTTCACCGGCCCCTTTCAAGGAGCTTTAAGGAGATGGGC
AAGCAGAACGGCTTTCTGTTCTATATCCCTGCCTGGAACACATCCAATATCGGACCCAACCACAGGCTTCGTGAAC
CTGTTTCACGTGCAGTACGAGAATGTGGATAAGGCCAAGGAGCTTCTTTCAGAAGTTCGACAGCATCTCCTACAAC
CCTAAGAAGGATTGGTTTGAGTTCGCCTTTGACTATAAGAACTTCACCAAGAAGGCCGAGGGCTCTAGGAGCATG
TGGATTCTGTGCACCCACGGCTCCCGGATCAAGAACTTCAGAAATTCTCAGAAGAATGGCCAGTGGGATAGCGAG
GAGTTTGCCCTGACCGAGGCCTTCAAGTCCCTGTTTGTGCGGTACGAGATCGATTATACCGCCGACCTGAAAACC
GCCATCGTGGACGAGAAGCAGAAGGATTTCTTTGTGGACCTGCTGAAGCTGTTCAAGCTGACCGTGCAGATGAGA
AACTCCTGGAAGGAGAAGGACCTGGATTACCTGATCTCTCCAGTGGCCGGCGCCGATGGCAGGTTCTTTGACACA
CGCGAGGGCAATAAGAGCCTGCCCAAGGACGCAGATGCAAACGGAGCCTATAATATCGCCCTGAAGGGCCTGTGG
GCACTGAGGCAGATCAGACAGACCTCCGAGGGCCGGCAAGCTGAAGCTGGCCATCTCTAACAAGGAGTGGCTGCAG
TTTGTGCACGAGAGATCCTACGAGAAGGAC
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 40G

MDSLKDFTNLYPVSKTLRFELKPVGKTLENIEKAGILKEDEHRAESYRRVKKIIDTYHKV
FIDSSLENMAKMGIENEIKAMLQSFCELYKKDHRTEGEDKALDKIRAVLRGLIVGAPTGV
CGRRENTVQNEKYESLFKEKLIKEILPDFVLSTEAESLPPSVEEATRSLKEFDSFTSYFA
GFYENRKNIYSTKPQSTAIAYRLIHENLPKFIDNILVPQKIKEFIAKELEHIRADFSAGG
YIKKDERLEDIPSLNYYIHVLSQAGIEKYNALIGKIVTEGDGEMKGLNEHINLYNQQRGR
EDRLPLFRPLYKQILSDREQLSYLPESFEKDEELLRALKEFYDHIAEDILGRTQQLMTSI
SEYDLSRIYVRNDSQLTDISKKMLGDWNAIYMARERAYDHEQAPKRITAKYERDRIKALK
GEESISLANLNSCIAFLDNVRDCRVDTYLSTLGQKEGPHGLSNLVENVFASYHEAEQLLS
FPYPEENNLIQDKDNVVLIKNLLDNISDLQRFLKPLWGMGDEPDKDERFYGEYNYIRGAL
DQVIPLYNKVRNYLTRKPYSTRKVKLNFGNSQLLSGWDRNKEKDNSCVILRKGQNFYLAI
MNNRHKRSFENKMLPEYKEGEPYFEKMDYKFLPDPNKMLPKVPLSKKGIEIYKPSPKLLE
QYGHGTHKKGDTFSMDDLHELIDFPKHSIEAHEDWKQPGFKPSDTATYENVSSFYREVED
QGYKLSFRKVSESYVYSLIDQGKLYLFQIYNKDFSPCSKGTPNLHTLYWRMLFDERNLAD
VIYKLDGKAEIPFREKSLKNDHPTHPAGKPIKKKSRQKKGEESLFEYDLVKDRRYTMDKP
QFHVPITMNFKCSAGSKVNDMVNAHIREAKDMHVIGIDRGERNLLYICVIDSRGTILDQI
SLNTINDIDYHDLLESRDKDRQQEHRNWQTIEGIKELKQGYLSQAVHRIAELMVAYKAVV
ALEDLNMGFKRGRQKVESSVYQQFEKQLIDKLNYLVDKKKRPEDIGGLLRAYQFTAPFKS
FKEMGKQNGPLPYIPAWNTSNIDPTTGFVNLFHVQYENVDKAKSPFQKFDSISYNPKKDW
FEFAFDYKNPTKKAEGSRSMWILCTHGSRIKNFRNSQKNGQWDSEEFALTEAFKSLFVRY
EIDYTADLKTAIVDEKQKDPFVDLLKLFKLTVQMRNSWKEKDLDYLISPVAGADGRFPDT
REGNKSLPKDADANGAYNIALKGLWALRQIRQTSEGGKLKLAISNKEWLQFVQERSYEKD

FIG. 40H

Restriction Enzymes                                                     Optimized

*Green: filtered sites; Blue: checked sites (not filtered); Red: kept sites.*

| | |
|---|---|
| BamHI(GGATCC) | 1(4024) |
| EcoRI(GAATTC) | 1(4114) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(4088) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

CIS-Acting Elements                                             Optimized

| | |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

Antiviral Motifs                                                      Optimized

After Optimization
    Max Direct Repeat:    Size:15 Distance:1842 Frequency:2
    Max Inverted Repeat: None
    Max Dyad Repeat:     None

TACTATTCCGTGATCGATATGAAGGGCAACATCGTGGAGCAGGACTCTCTGAATATCATCAGGAACAATGACCTG
GAGACAGATTACCACGACCTGCTGGATAAGAGGGAGAAGGAGCGCAAGGCCAACCGGCAGAATTGGGAGGCCGTG
GAGGGCATCAAGGACCTGAAGAAGGGCTACCTGAGCCAGGCCGTGCACCAGATCGCCCAGCTGATGCTGAAGTAT
AACGCCATCATCGCCCTGGAGGATCTGGGCCAGATGTTTGTGACCCGCGGCCAGAAGATCGAGAAGGCCGTGTAC
CAGCAGTTCGAGAAGAGCCTGGTGGATAAGCTGTCCTACCTGGTGGACAAGAAGCGGCCTTATAATGAGCTGGGC
GGCATCCTGAAGGCCTACCAGCTGGCCTCTAGCATCACCAAGAACAATTCTGACAAGCAGAACGGCTTCCTGTTT
TATGTGCCAGCCTGGAATACAAGCAAGATCGATCCCGTGACCGGCTTTACAGACCTGCTGCGGCCCAAGGCCATG
ACCATCAAGGAGGCCCAGGACTTCTTTGGCGCCTTCGATAACATCTCTTACAATGACAAGGGCTATTTCGAGTTT
GAGACAAACTACGACAAGTTTAAGATCAGAATGAAGAGCGCCCAGGACCAGGTGGACAATCTGCACCTTCGGCAAT
CGGATCAAGGCAAAGAAGGATAAGAACTACTGGAATTATGAGGAGGTGGAGCTGACCGAGGAGTTCAAGAAGCTG
TTTAAGGACAGCAACATCGATTACGAGAACTGTAATCTGAAGGAGGAGATCCAGAACAAGGACAATCGCAAGTTC
TTTGATGACCTGATCAAGCTGCTGCAGCTGACACTGCAGATGCGGAACTCCGATGACAAGGGCAATGATTATATC
ATCTCTCCTGTGGCCAACGCCGAGGGCCAGTTCTTTGACTCCCGCAATGGCGATAAGAAGCTGCCACTGGATGCA
GACGCAAACGGAGCCTACAATATCGCCCGGCAAGGGCCTGTGGAACATCCGGCAGATCAAGCAGACCAAGAACGAC
AAGAAGCTGAATCTGAGCATCTCCTCTACAGAGTGGCTGGATTTCGTGCGGGAGAAGCCTTACCTGAAG
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC

FIG. 41G

MENYQEPTNLFQLNKTLRFELKPIGKTCELLEEGKIPASGSFLEKDKVRADNVSYVKKEI
DKKHKIPIEETLSSFSISNDLLKQYFDCYNELKAFKKDCKSDEEEVKKTALRNKCTSIQR
AMREAISQAFLKSPQKKLLAIKNLIENVFKADENVQHPSEPTSYPSGFETNRENFYSDEE
KSTSIAYRLVHDNLPIPIKNIYIFEKLKEQFDAKTLSEIFENYKLYVAGSSLDEVFSLEY
FNNTLTQKGIDNYNAVIGKIVKEDKQEIQGLNEHINLYNQKHKDRRLPFFISLKKQILSD
REALSWLPDMFKNDSEVIKALKGFYIEDGFENNVLTPLATLLSSLDKYNLNGIFIRNNEA
LSSLSQNVYRNFSIDEAIDANAELQTFNNYELIANALRAKIKKETKQGRKSFEKYEEYID
KKVKAIDSLSIQEINELVENYVSEFNSNSGNMPRKVEDYFSLMRKGDFGSNDLIENIKTK
LSAAEKLLGTKYQETAKDIFKKDENSKLIKELLDATKQFQHFIKPLLGTGEEADRDLVFY
GDFLPLYEKFEELTLLYNKVRNRLTQKPYSKDKIRLCFNKFKLMTGWVDSKTEKSDNGTQ
YGGYLFRKKNEIGEYDYPLGISSKAQLFRKNEAVIGDYERLDYYQPKANTIYGSAYEGEN
SYKEDKKRLNKVIIAYIEQIKQTNIKKSIIESISKYPNISDDDKVTPSSLLEKIKKVSID
SYNGILSFKSFQSVNKEVIDNLLKTISPLKNKAEFLDLINKDYQIFTEVQAVIDEICKQK
TPIYFPISNVELEKEMGDKDKPLCLFQISNKDLSPAKTFSANLRKKRGAENLHTMLPKAL
MEGNQDNLDLGSGAIFYRAKSLDGNKPTHPANEAIKCRNVANKDKVSLFTYDIYKNRRYM
ENKFLFHLSIVQNYKAANDSAQLNSSATEYIRKADDLHIIGIDRGERNLLYYSVIDMKGN
IVEQDSLNIIRNNDLETDYHDLLDKREKERKANRQNWEAVEGIKDLKKGYLSQAVHQIAQ
LMLKYNAIIALEDLGQMFVTRGQKIEKAVYQQFEKSLVDKLSYLVDKKRPYNELGGILKA
YQLASSITKNNSDKQNGFLFYVPAWNTSKIDPVTGFTDLLRPKAMTIKEAQDFFGAFDNI
SYNDKGYFEFETNYDKFKIRMKSAQTRWTICTPGNRIKRKKDKNYWNYEEVELTEEFKKL
FKDSNIDYENCNLKEEIQNKDNRKFFDDLIKLLQLTLQMRNSDDKGNDYIISPVANAEGQ
FFDSRNGDKKLPLDADANGAYNIARKGLWNIRQIKQTKNDKKLNLSISSTEWLDFVREKP
YLK

FIG. 41H

| Restriction Enzymes | Optimized |
|---|---|
| *Green: filtered sites; Blue: checked sites (not filtered); Red: kept sites. | |
| BamHI(GGATCC) | 1(3793) |
| EcoRI(GAATTC) | 1(3883) |
| HindIII(AAGCTT) | 0 |
| BsmBI(CGTCTC) | 0 |
| BsaI(GGTCTC) | 0 |
| BbsI(GAAGAC) | 0 |
| AgeI(ACCGGT) | 0 |
| XhoI(CTCGAG) | 0 |
| NdeI(CATATG) | 1(3857) |
| NotI(GCGGCCGC) | 0 |
| KpnI(GGTACC) | 1(1) |
| BsrGI(TGTACA) | 0 |
| SpeI(ACTAGT) | 0 |
| XbaI(TCTAGA) | 0 |
| NheI(GCTAGC) | 0 |
| ARE | 0 |

| CIS-Acting Elements | Optimized |
|---|---|
| Splice(GGTAAG) | 0 |
| Splice(GGTGAT) | 0 |
| PolyA(AATAAA) | 0 |
| PolyA(ATTAAA) | 0 |
| Destabilizing(ATTTA) | 0 |
| PolyT(TTTTTT) | 0 |
| PolyA(AAAAAAA) | 0 |

| Antiviral Motifs | Optimized |
|---|---|
| | 0 |

FIG. 42D

After Optimization
    Max Direct Repeat:   Size:13 Distance:99 Frequency:2
    Max Inverted Repeat: None
    Max Dyad Repeat:   None

```
GAGAACCTGAATCTGAGCTTCATGAAGGGGCAGGAAGAAGGTGGAGAAGTCCGTGTACGAGAAGTTTGAGCGCATG
CTGGTGGACAAGCTGAACTATCTGGTGGTGGATAAGAAGAACCTGTCCAATGAGCCAGGAGGCCTGTATGCAGCA
TACCAGCTGACCAATCCACTGTTCTCTTTTGAGGAGCTGCACAGATACCCCCAGAGCGGGCATCCTGTTTTTCGTG
GACCCATGGAACACCTCTCTGACAGATCCCAGCACAGGCTTCGTGAATCTGCTGGGCAGAATCAACTACACCAAT
GTGGGCGACGCCCGCAAGTTTTTCGATCGGTTTAACGCCATCAGATATGACGGCAAGGGCAATATCCTGTTCGAC
CTGGATCTGTCCAGATTTGATGTGAGGGTGGAGACACAGAGGAAGCTGTGGACACTGACCACATTCGGCTCTCGC
ATCGCCAAATCCAAGAAGTCTGGCAAGTGGATGGTGGAGCGGATCGAGAACCTGAGCCTGTGCTTTCTGGAGCTG
TTCGAGCAGTTTAATATCGGCTACAGAGTGGAGAAGGACCTGAAGAAGGCCATCCTGAGCCAGGATAGGAAGGAG
TTCTATGTGCGCCTGATCTACCTGTTTAACCTGATGATGCAGATCCGGAACAGCGACGGCGAGGAGGATTATATC
CTGTCTCCCGCCCTGAACGAGAAGAATCTGCAGTTCGACAGCAGGCTGATCGAGGCCAAGGATCTGCCTGTGGAC
GCAGATGCAAACGGAGCATACAATGTGGCCCGCAAGGGCCTGATGGTGGTGCAGAGAATCAAGAGGGGCGACCAC
GAGTCCATCCACAGGATCGGAAGGGCACAGTGGCTGAGATATGTGCAGGAGGGCATCGTGGAG
AAAAGGCCGGCGGCCACGAAAAAGGCCGGCCAGGCAAAAAAGAAAAAGGGATCCTACCCATACGATGTTCCAGAT
TACGCTTATCCCTACGACGTGCCTGATTATGCATACCCATATGATGTCCCCGACTATGCCTAAGAATTC
```

FIG. 42G

MKTQHFPEDFTSLYSLSKTIRPELKPIGKTLENIKKNGLIRRDEQRLDDYEKLKKVIDEY
HEDFIANILSSFSFSEEILQSYIQNLSESEARAKIEKTMRDTLAKAPSEDERYKSIPKKE
LVKKDIPVWCPAYKSLCKKFDNFTTSLVPFHENRKNLYTSNEITASIPYRIVHVNLPKFI
QNIEALCELQKKMGADLYLEMMENLRNVWPSFVKTPDDLCNLKTYNHLMVQSSISEYNRF
VGGYSTEDGTKHQGINEWINIYEQRNKEMRLPGLVFLHKQILAKVDSSSFISDTLENDDQ
VFCVLRQFRKLFWNTVSSKEDDAASLKDLPCGLSGYDPEAIYVSDAHLATISKNIFDRWN
YISDAIRRKTEVLMPRKKESVERYAEKISKQIKKRQSYSLAELDDLLAHYSEESLPAGFS
LLSYPTSLGGQKYLVSDGEVILYEEGSNIWDEVLIAPRDLQVILDKDPTEKKLGKDEEAV
SVIKKALDSALRLRKFFDLLSGTGAEIRRDSSFYALYTDRMDKLKGLLKMYDKVRNYLTK
KPYSIEKFKLHFDNPSLLSGWDKNKELNNLSVIFRQNGYYYLGIMTPKGKNLFKTLPKLG
AEEMPYEKMEYKQIAEPMLMLPKVFFPKKTKPAPAPDQSVVDIYNKKTFKTGQKGFNKKD
LYRLIDFYKEALTVHEWKLFNFSFSPTEQYRNIGEFPDEVREQAYKVSMVNVPASYIDEA
VENGKLYLPQIYNKDFSPYSKGIPNLHTLYWKALPSEQNQSRVYKLCGGGELFYRKASLH
MQDTTVHPKGISIHKKNLNKKGETSLFNYDLVKDKRPTEDKFPFHVPISINYKNKKITNV
NQMVRDYIAQNDDLQIIGIDRGERNLLYISRIDTRGNLLEQPSLNVIESDKGDLRTDYQK
ILGDREQERLRRRQEWKSIESIKDLKDGYMSQVVHKICNMVVEHKAIVVLENLNLSFMKG
RKKVEKSVYEKFERMLVDKLNYLVVDKKNLSNEPGGLYAAYQLTNPLFSFEELHRYPQSG
ILFFVDPWNTSLTDPSTGFVNLLGRINYTNVGDARKFFDRFNAIRYDGKGNILFDLDLSR
FDVRVETQRKLWTLTTPGSRIAKSKKSGKWMVERIENLSLCFLELFEQFNIGYRVEKDLK
KAILSQDRKEFYVRLIYLPNLMMQIRNSDGEEDYILSPALNEKNLQFDSRLIEAKDLPVD
ADANGAYNVARKGLMVVQRIKRGDHESIHRIGRAQWLRYVQEGIVE

FIG. 42H

>1 DR
GUCUAAGAACUUUAAAUAAUUUCUACUGUUGUAGAU
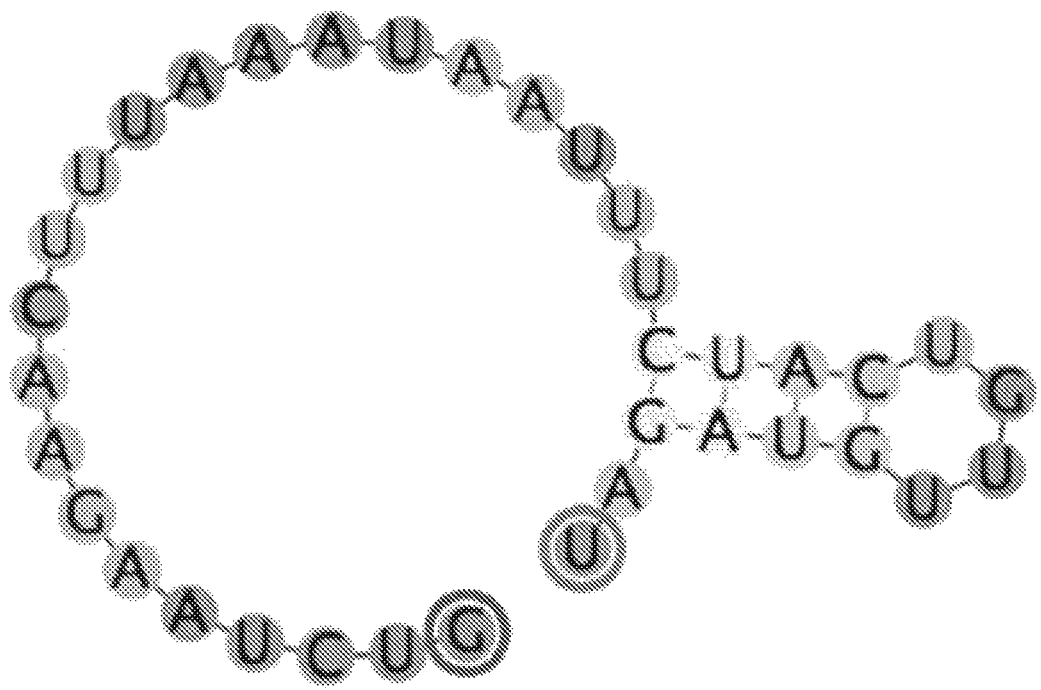
>2 DR
GCUAUAAUGCCUAUAUAAUUUCUACUAUUGUAGAU
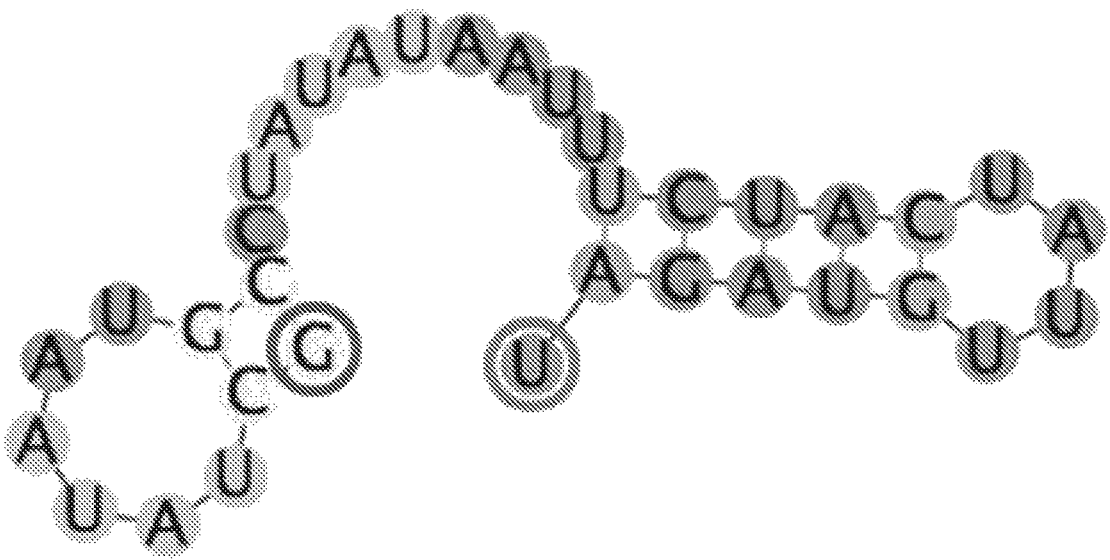
FIG. 43A >3 DR
GCCUAUAAGGCUUUAGUAAUUUCUACUAUUGUAGAU
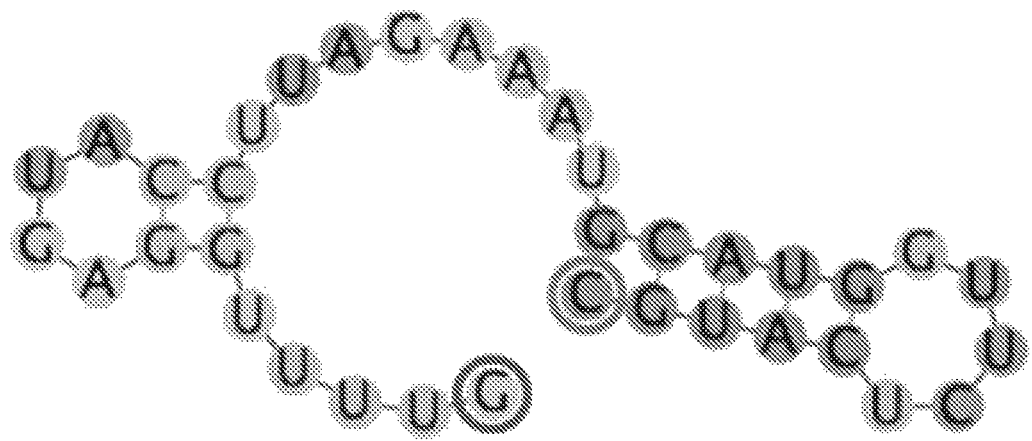
>4 DR
GUCAAUAAGACUCAUUUAAUUUCUACUUCGGUAGAU
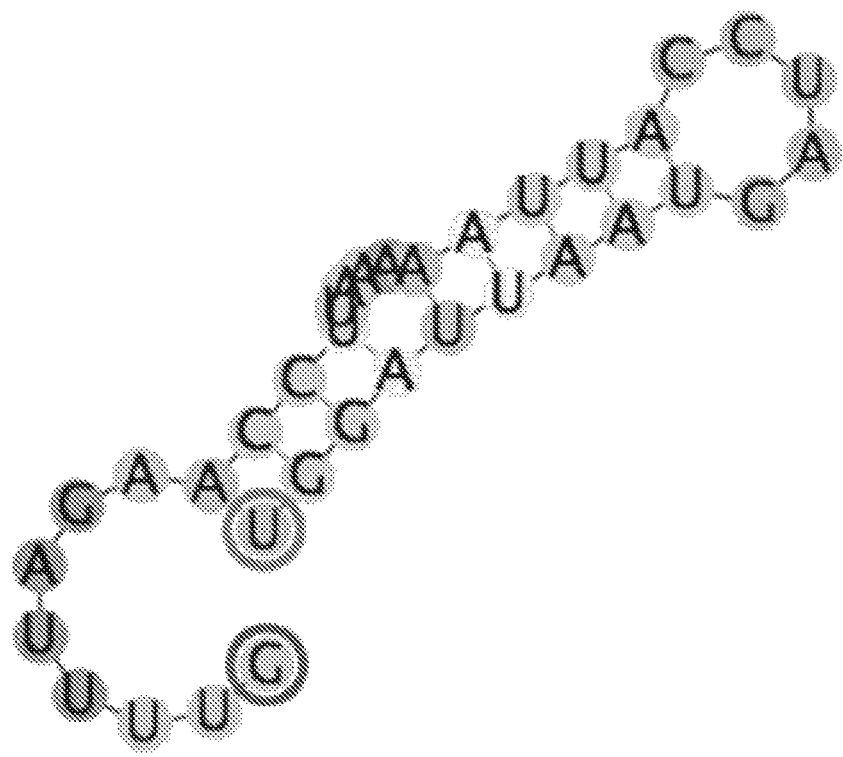
FIG. 43B >5 DR
GUCUAGGUACUCUCUUUAAUUUCUACUAUUGUAGAU
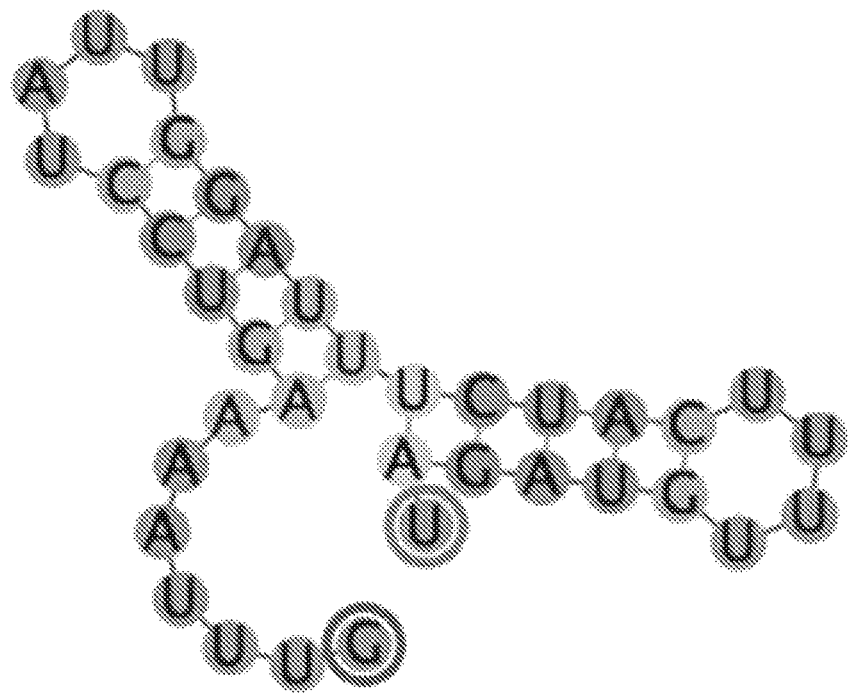
>6 DR
GUUUCAAAGAUUAAAUAAUUUCUACUAAGUGUAGAU
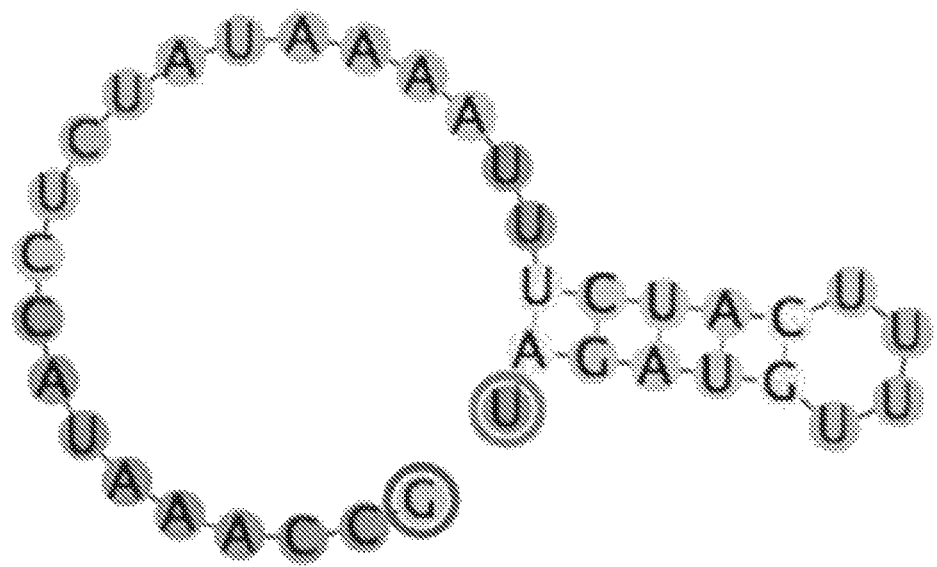
FIG. 43C >7 DR
CUCUAAAGAGAGGAAAGAAUUCUACUUUUGUAGAU
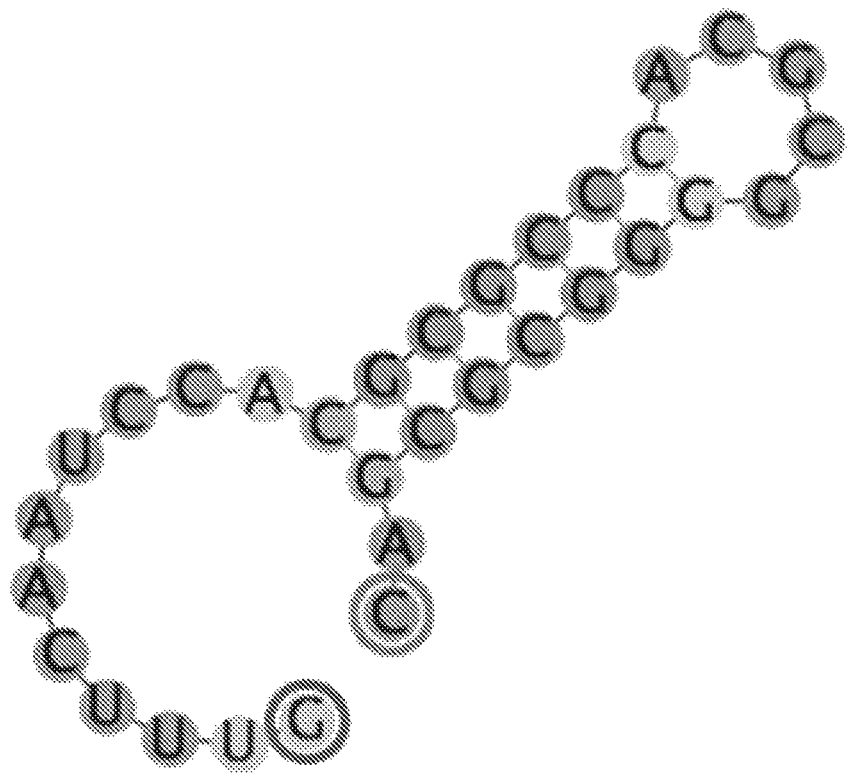
>8 DR
GUCUAACGACCUUUUAAAUUCUACUGUUUGUAGAU
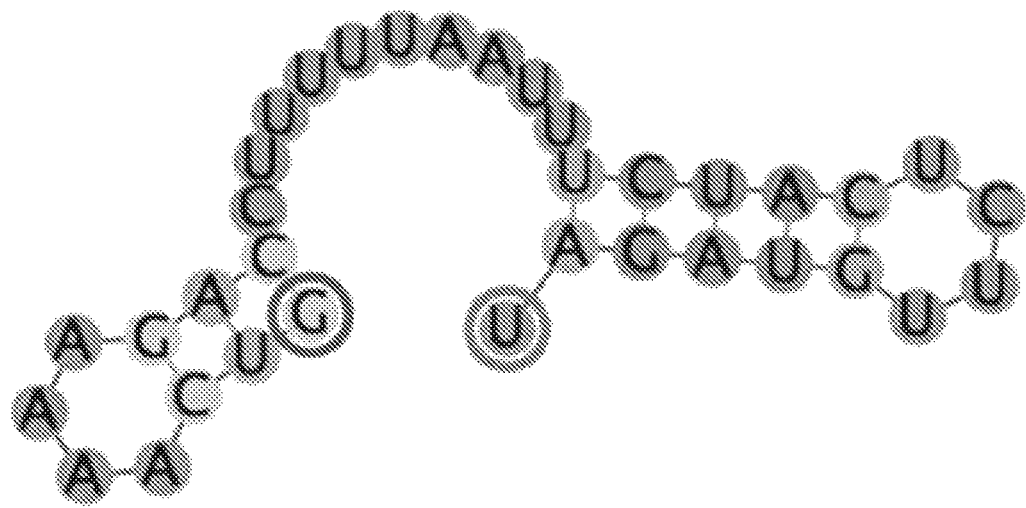
FIG. 43D >9 DR
GUUUGAAUAACCUUAAAUAAUUCUACUUUGUAGAU
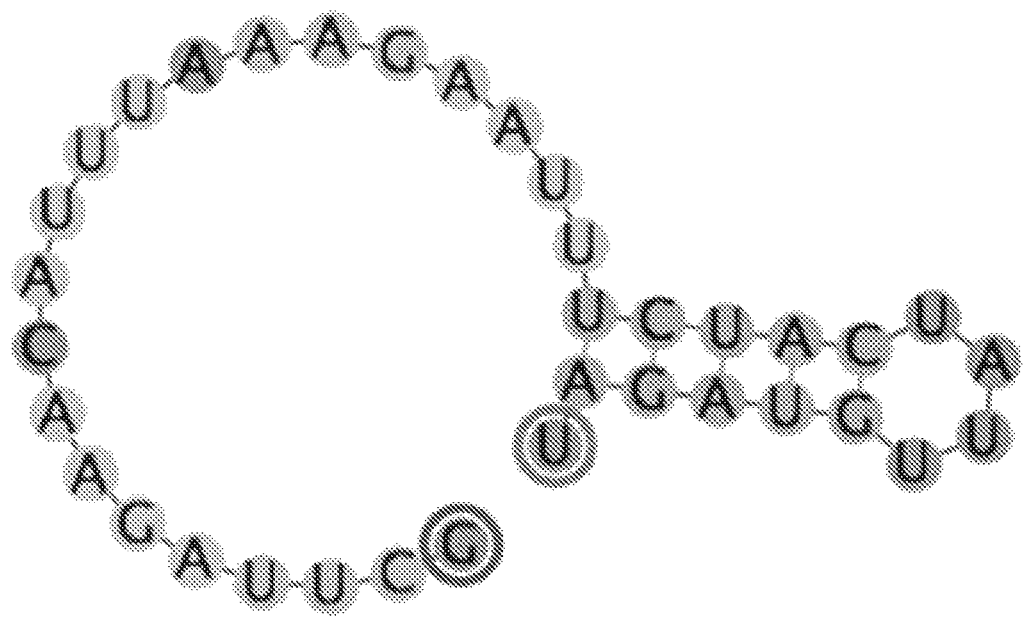
>10 DR
CUCAAAACUCAUUCGAAUCUCUACUCUUUGUAGAU
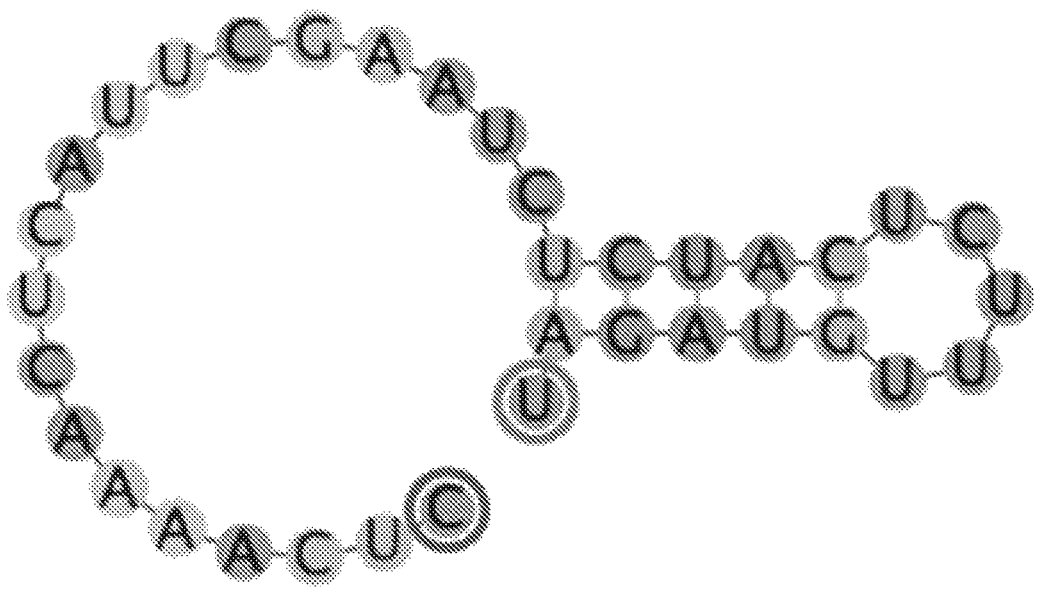
FIG. 43E >11 DR
GCUUAGAACAUUUAAAGAAUUUCUACUAUUGUAGAU
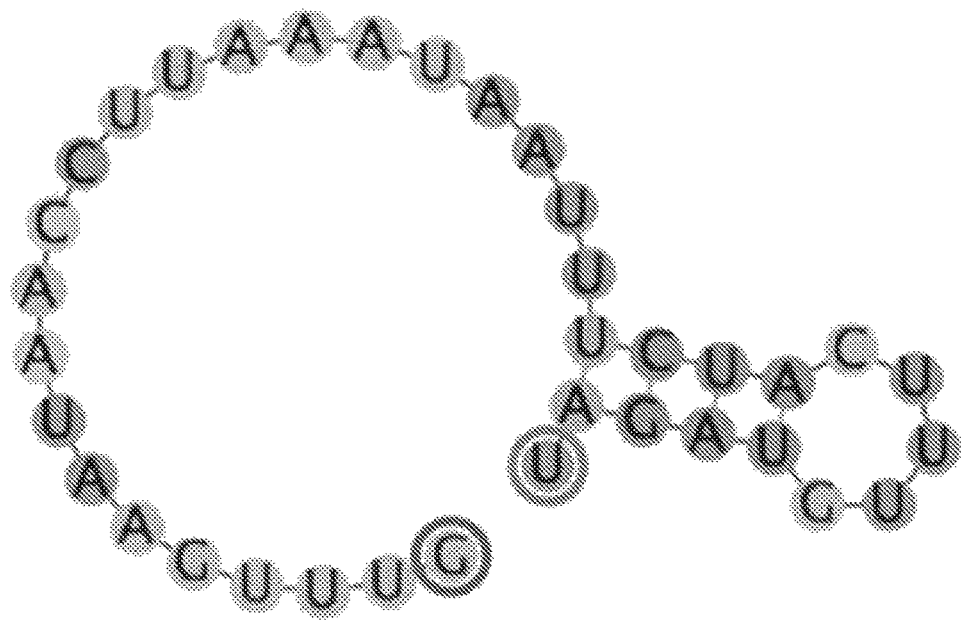
>12 DR
GUCAAAAGACCUUUUUAAUUUCUACUCUUGUAGAU
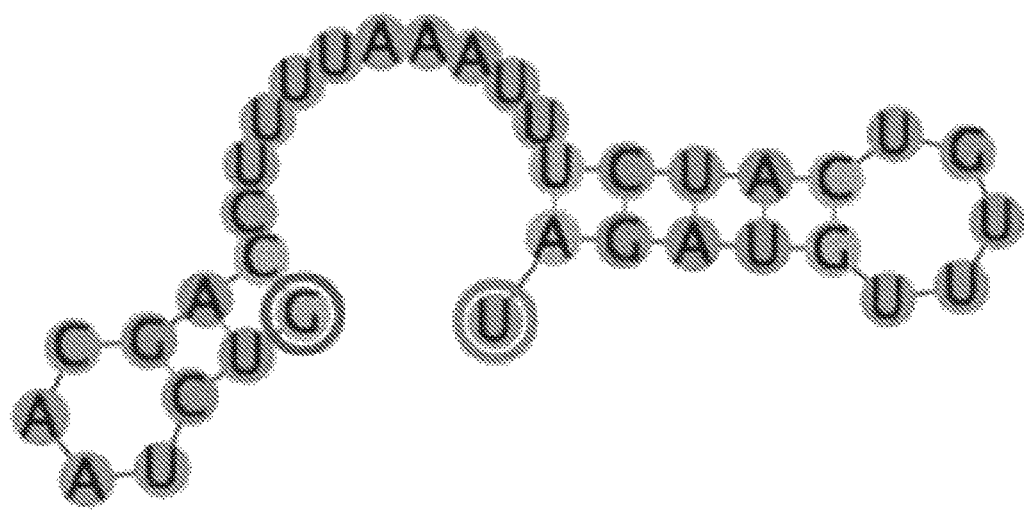
FIG. 43F >13 DR
GUUCAAUCCACGCGCCCACGCGGGGCGCGAC
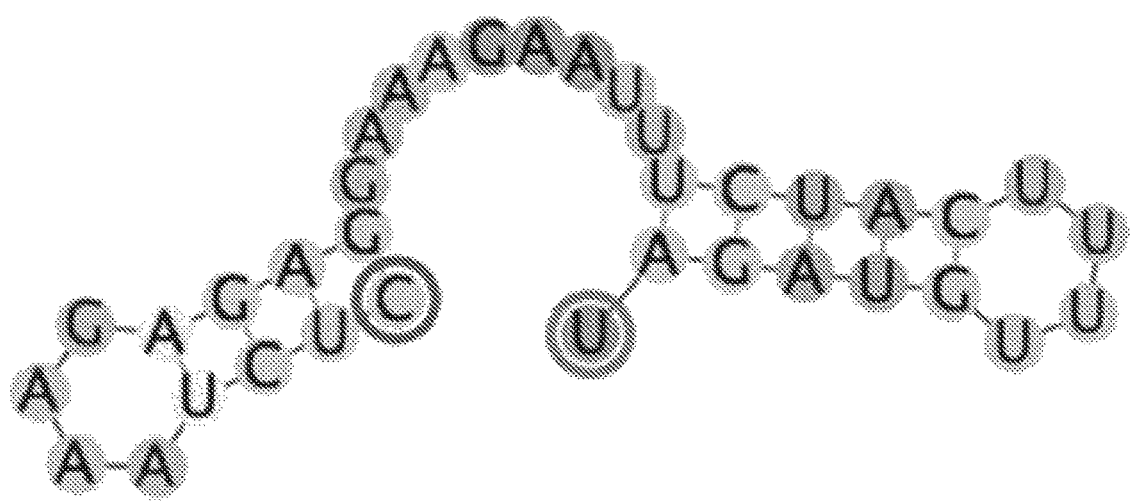
>14 DR
GCCAAAUACCUCUAUAAAAUUUCUACUUUUGUAGAU
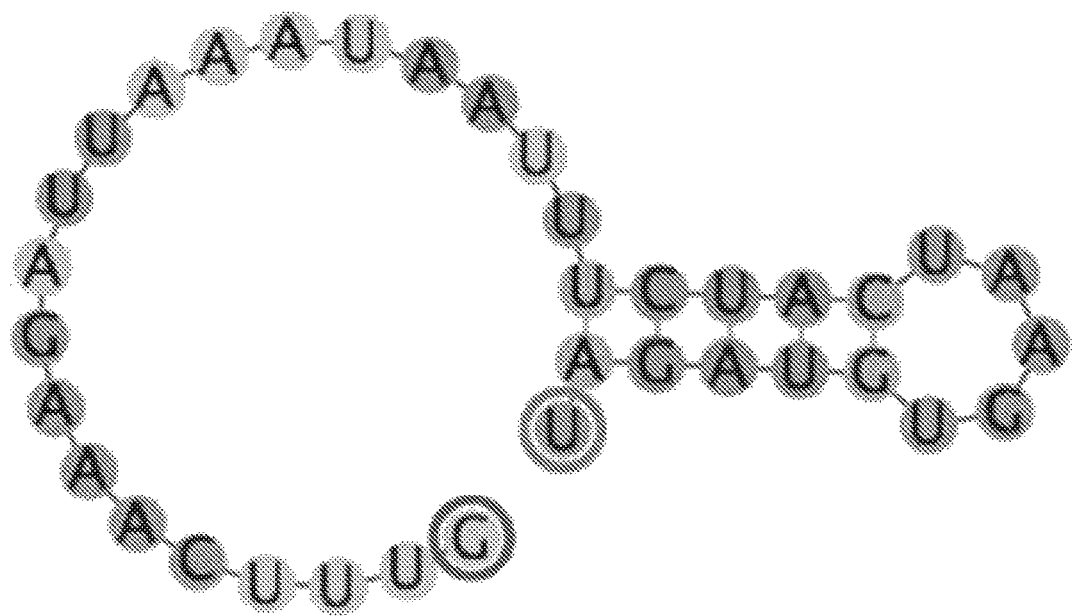
FIG. 43G >15 DR
GUUUAAAAGUCCAUUGGAUUCUACUUUUGUAGAU
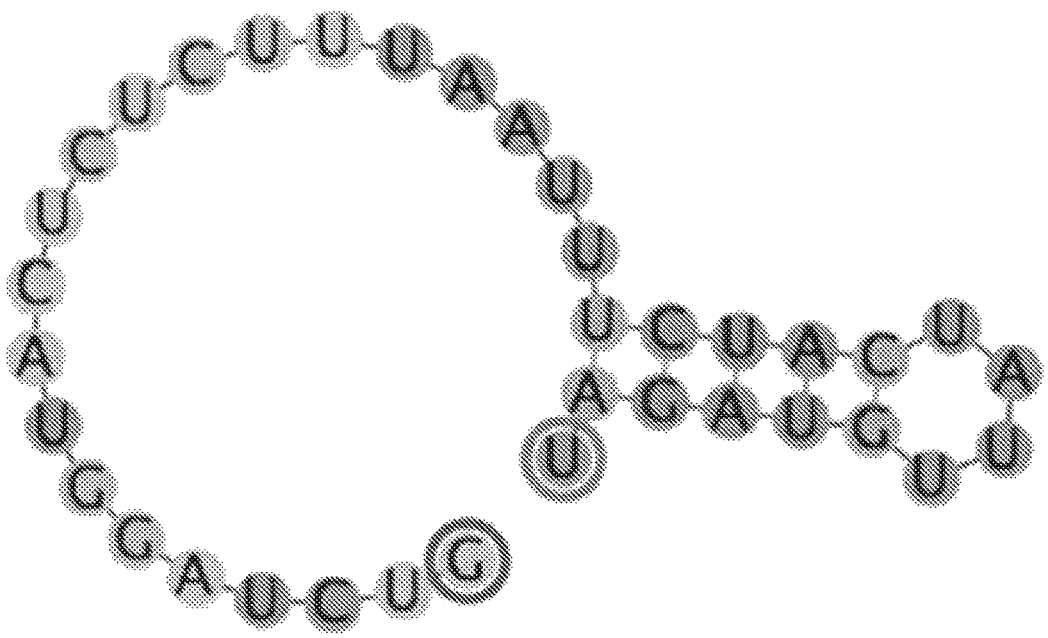
>16 DR
GUUUUAGAACCUUAAAAAUUACCUAGUAAUUAGGU
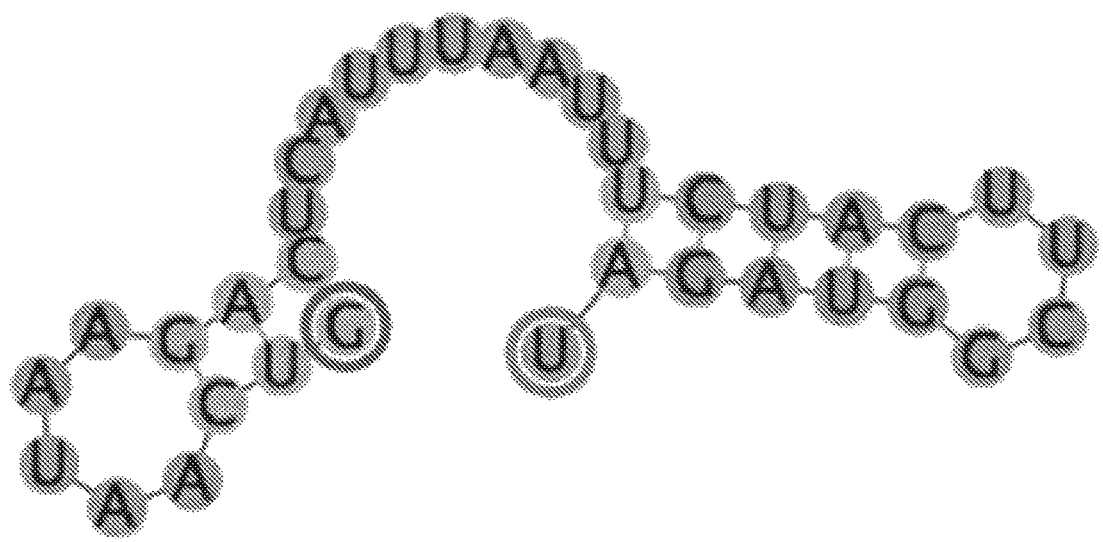
FIG. 43H

>17 DR
GUUUUGGAGUACCUUAGAAAUGCAUGGUUCUCAUGC

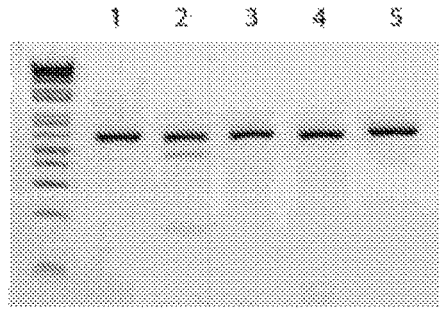

| Lane | crRNA | DNA substrate |
|---|---|---|
| 1 | Emx1 crRNA1 | EMX1 amplicon |
| 2 | Emx1 crRNA2 | EMX1 amplicon |
| 3 | Emx1 crRNA10 | EMX1 amplicon |
| 4 | Emx1 crRNA13 | EMX1 amplicon |
| 5 | none | EMX1 amplicon | crRNA sequences (5' to 3')

crRNA1
    GGGACUUUAAAUAAUUUCUACUGUUGUAGAUAGGCCCCAGUGGCUGCUCUGGGGCCUCCGUCUAAGAACUUUAAAU crRNA2
    GGGACUUUAAAUAAUUUCUACUGUUGUAGAUUCAUCCGGGCCCUCCCUCCCUGGCCCAGGUCUAAGAACUUUAAAU crRNA10
    GGGACUUUAAAUAAUUUCUACUGUUGUAGAUGUGGGUGCCCACCCUAGUCAUUGGACAUUGGUCUAAGAACUUUAAAU crRNA13
    GGGACUUUAAAUAAUUUCUACUGUUGUAGAUGGCGCCCCAGGCCCAGGUCCCUCUGACCGUCUAAGAACUUUAAAU

EMX1 amplicon sequence:

Ccatcccttctgtgaatgttagacccatgggagcagctggtcagaggggacccccggcctgggg
ccctaaccctatgtagcctcagtcttcccatcaggctctcagctcagcctgagtgttgaggcc
ccagtggctgctctgggggcctcctgagtttctcatctgtgccccctccctccctggcccaggtg
aaggtgtggttccagaaccggaggacaaagtacaaacggcagaagctggaggaggaagggcctg
agtccgagcagaagaagaagggctcccatcacatcaaccggtggcgcattgccacgaagcaggc
caatggggaggacatcgatgtcacctccaatgactagggtgggcaaccacaaacccacgagggc
agagtgctgcttgctgctggccaggccctgcgtgggcccaagctggactctggccactccctg
gccaggctttggggaggcctggagtcatggccccacaggcttgaagccccggggccgccattga
cagagggacaagcaatgggctggctgaggcctggaccacttggccttctcctggagagcctg
cctgcctgggcggccccgccgccaccgcagcctccagctgctctccgtgtctccaatctcc

FIG. 44

Each lane consists of Cpf1-containing cell lysate, pUC19 with TTc protospacer, and the corresponding crRNA, indicated as 1-11.

crRNA sequences (5' to 3', mismatch base underlined)

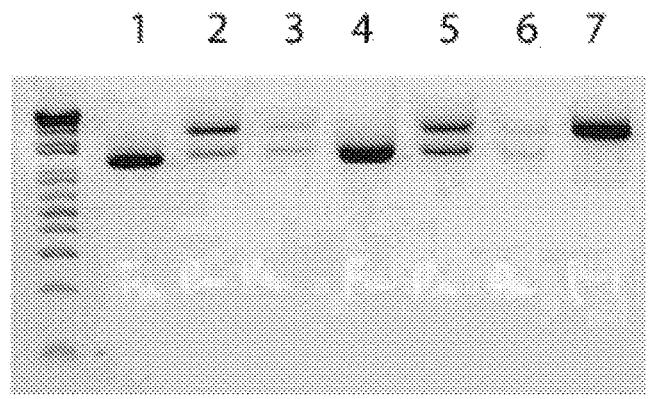

| Lane | Purified Protein Soln | crRNA |
|---|---|---|
| | DNA substrate | |
| 1 | FnCpf1 | spacer1-targeting crRNA |
| | pUC with TTc protospacer | |
| 2 | PaCpf1 | spacer1-targeting crRNA |
| | pUC with TTc protospacer | |
| 3 | PaCpf1 | spacer1-targeting crRNA |
| | pUC with TTc protospacer | |
| 4 | GST-FnCpf1 | spacer1-targeting crRNA |
| | pUC with TTc protospacer | |
| 5 | GST-PaCpf1 | spacer1-targeting crRNA |
| | pUC with TTc protospacer | |
| 6 | MBP-PaCpf1 | spacer1-targeting crRNA |
| | pUC with TTc protospacer | |
| 7 | none | spacer1-targeting crRNA |
| | pUC with TTc protospacer | | spacer1-targeting crRNA sequence (5' to 3'):

acuuuaaauaauuucuacuguuguagaugagaagucauuuaauaaggccacuguaaaaguucuaagaacu
uuaaau

FIG. 47

FnCpf1 DR secondary structure (stem loop highlighted):

PaCpf1 DR secondary structure (stem loop highlighted, identical except for a single base difference in the loop region):

Mature crRNA sequences for FnCpf1 have the form of:

5'-AAUUUCUACUGUUGUAGAUN$_{20-24}$-3'

Mature crRNA sequences for PaCpf1 have the form of:

5'-AAUUUCUACUAUUGUAGAUN$_{20-24}$-3'

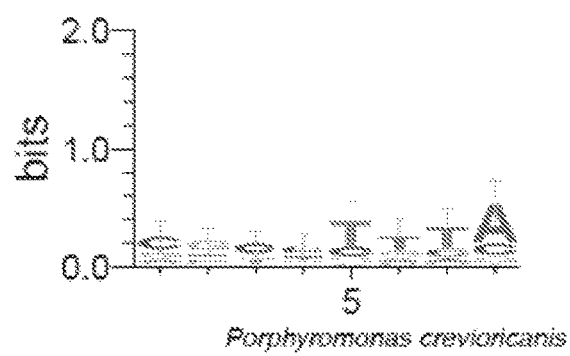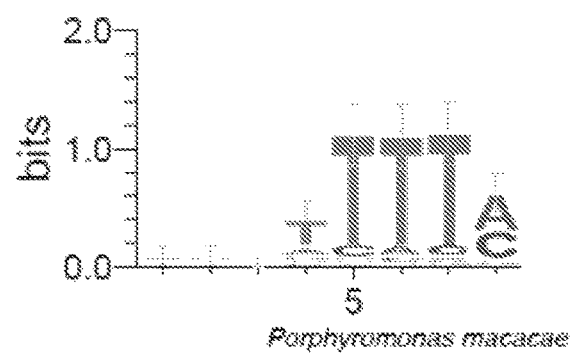
FIG. 53C

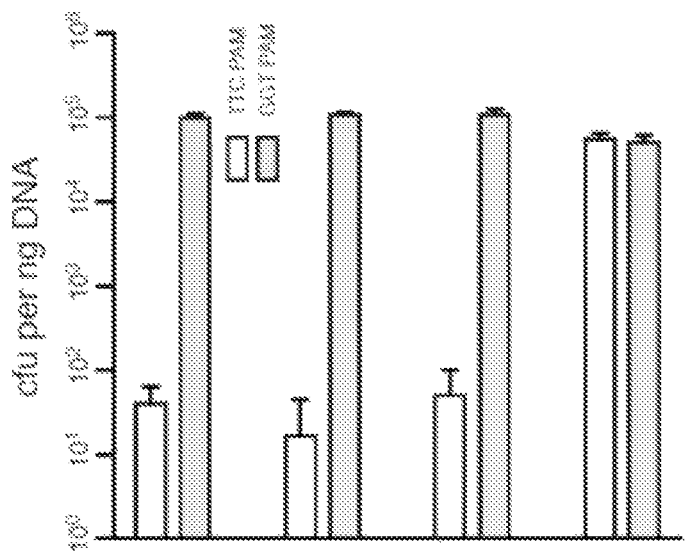
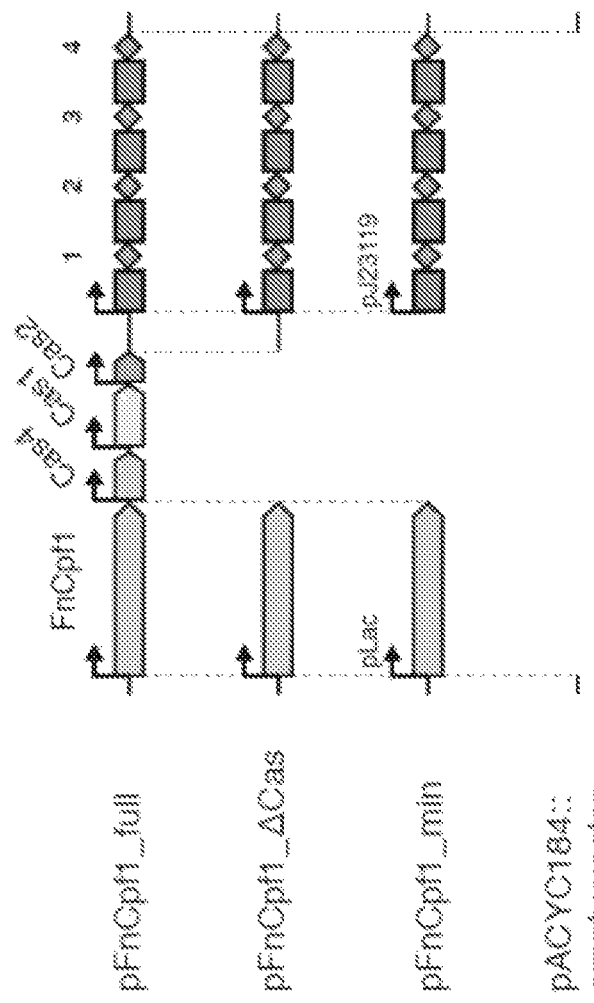
FIG. 59C

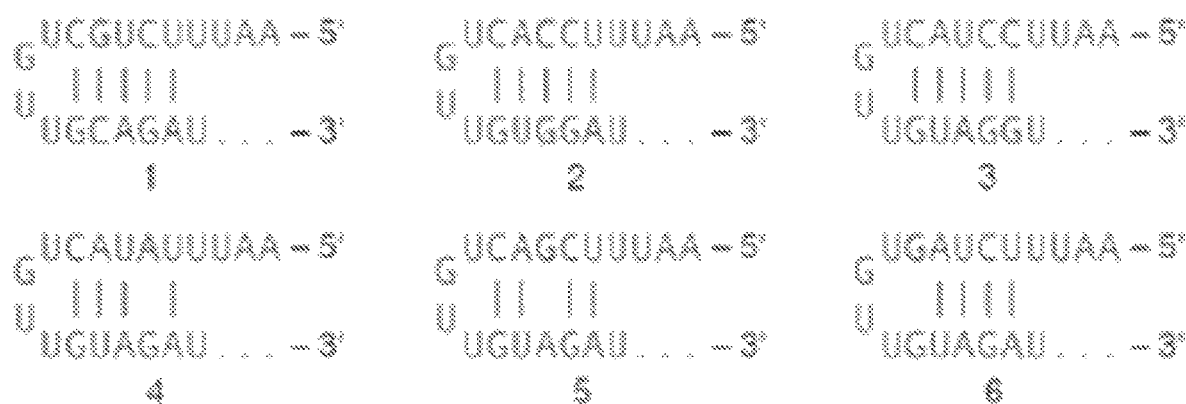
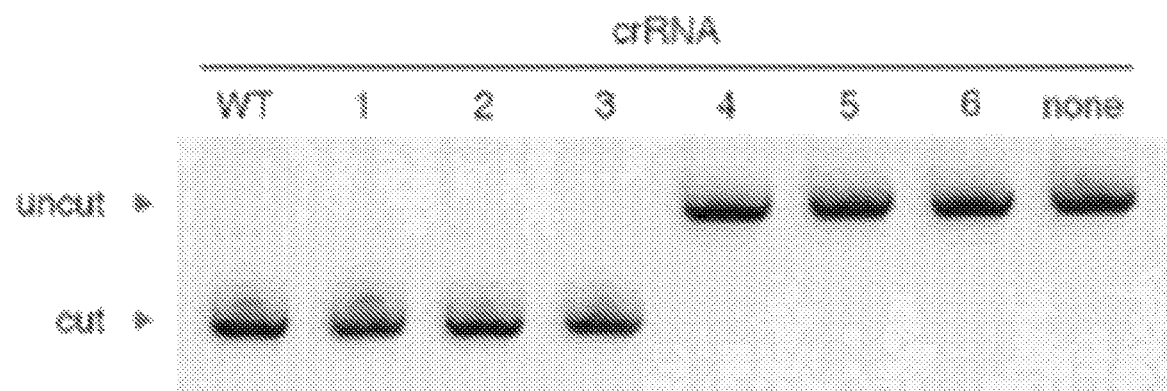
FIG. 62D

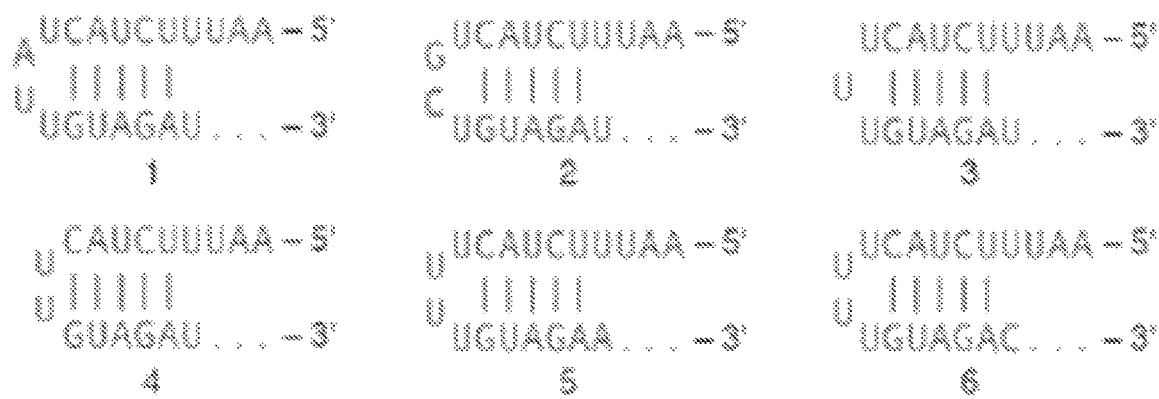
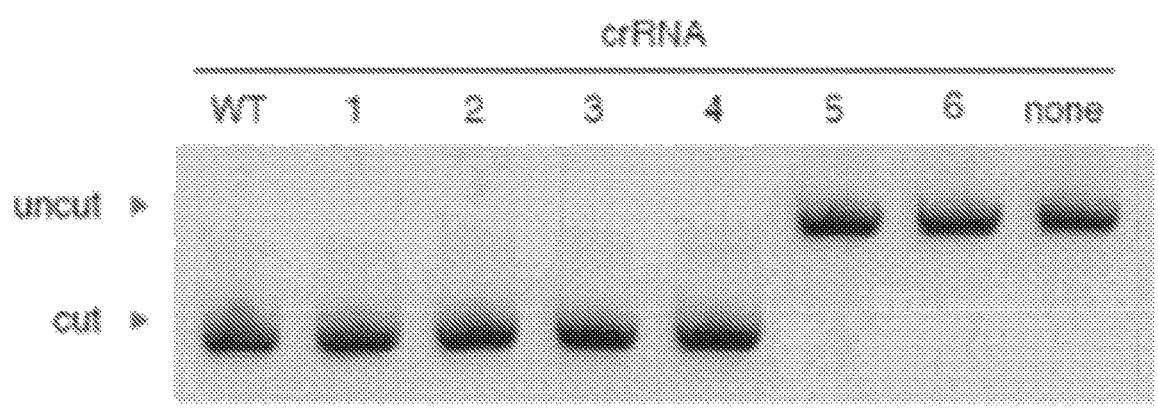
FIG. 62E direct repeat sequences of Cpf1 orthologs

| ID | | | | |
|----|----|----|----|----|
| 1 | FnCpf1 | 5'− GUCUAAGAACUUUAAA | UAAUUUCUACU−GUUGUAGAU | −3' |
| 2 | Lb3Cpf1 | GUUUUGGACUACCUU | AGAAAUGCAUGGUUCUCAUGC | |
| 3 | BpCpf1 | GUUUAGAACCUUA | AAAAUUACCUAGUAAUUAGGU | |
| 4 | PeCpf1 | GUUAAAGUCCUAUU | GGAUUUCUACU−UUUGUAGAU | |
| 5 | PbCpf1 | GCCAAAUACCUCUAUA | AAAUUUCUACU−UUUGUAGAU | |
| 6 | BoCpf1 | GUUUCAAUCCACGCGCCCACGCGGGGCGCGAC | | |
| 7 | AsCpf1 | GUCAAAGACCUUU | UAAUUUCUACU−CUUGUAGAU | |
| 8 | Lb2Cpf1 | GCUUAGAACAUUUAA | GAAUUUCUACU−AUUGUAGAU | |
| 9 | CMtCpf1 | CUCAAAACUCAUUC | GAAUCUCUACUCUUUGUAGAU | |
| 10 | EeCpf1 | GUUGAAUAACCUUAA | UAAUUUCUACU−−UUGUAGAU | |
| 11 | MbCpf1 | GUCUAACGACCUUU | AAAUUUCUACUGUUUGUAGAU | |
| 12 | LiCpf1 | CUCUAAGAGACCAA | GAAUUUCUACU−UUUGUAGAU | |
| 13 | LbCpf1 | GUUUCAAAGAUUAA | UAAUUUCUACUAAGUGUAGAU | |
| 14 | PcCpf1 | GUCUAGGUACUCUCUU | UAAUUUCUACU−AUUGUAGAU | |
| 15 | PxCpf1 | GUCAAUAGACUCAUU | UAAUUUCUACU−UCGGUAGAU | |
| 16 | PmCpf1 | GCCUAUAAGGCUUUAC | UAAUUUCUACU−AUUGUAGAU | | removed post crRNA maturation     stem left     stem right

FIG. 63C

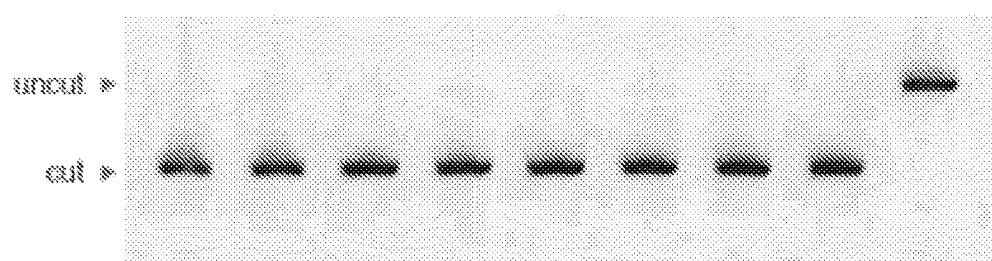
FIG. 63E

```
                    PAM          guide sequence
Cpf1        1  TTTCCTCACTCCTGCTCGGTGAATTT
DNMT1       2  TTTGAGGAGTGTTCAGTCTCCGTGAAC
target      3  TTTCCTGATGGTCCATGTCTGTTACTC
sites       4  TTTATTTCCCTTCAGCTAAAATAAAGG guide sequence         PAM
SpCas9      1  TCACTCCTGCTCGGTGAATTTGG
DNMT1       2  AACCCTCTGGGGACCGTTTGAGG
target      3  AGTACGTTAATGTTTCCTGATGG
sites       4  TTTCCTTCAGCTAAAATAAAGG
```

FIG. 64D

```
                    αα                              αααααα                    αααααααααα
         1         10         20         30         40         50
FnCpf1   MSIYQEFVNKYSLSKTLRFELIPQGKTLENIKARGLILDDEKRAKDYKKAKQ
AsCpf1   MTQFEGFTNLYQVSKTLRFELIPQGKTLKHIQEQGFIEEDKARNDHYKELKP
Lb3Cpf1  MSKLEKFTNCYSLSKTLRFKATEVGIIQENIDNKRLLVEDEKRAEDYKGVEK
                                                        α  αααααα

αααα                    αααααααααααα        αααααααα
         110        120        130        140         1
FnCpf1   SEYIKD..............SEKFSNGNQNLIDAKKGQESDLILWLQSKDN
AsCpf1   HDYFIGRTDNLTDAINKRHAIIYDGSSKAELFNG................
Lb3Cpf1  AKAFKG..............NGYKSFKKDIIET.................
         αααα                  α αα   αααα

ααααααα      αα αα    αα    αααααααααααα
         210        220        230        240        250
FnCpf1   DNLPKFLENKAKYESLKDKAPEAINYEQIKKDLAEELTFDIDYKTSEVNQRV
AsCpf1   DNFPKFKENCHIFTRLITAVP...SLREHFENVKKAIGIFVSTS........
Lb3Cpf1  ENLTRYISNDIFEKVD.....AIFDKHEVQEIKEKILNSDYD........
         αααααααα        αααααααα    ααα   ααααααααααα

α...ααα   αααα                                αααααααααα
         320        330        340        350         360
FnCpf1   T....LKKYKNSVLFLQISDTESKSEVIDKLEDDSDVVTTNQSFYEQIAAF
AsCpf1   AHIIASLPHRFIPLFKQISDRNTLSILEEFKSDEEVIQSFCKYKT.....
Lb3Cpf1  .....LPKFKP..LYKGVSDRESLSHYGEGYTSDEEVLEVFRNTLN.....
                            ααα                ααααααααααα

αααααααααα         αααααααααα α         ααααα.αααααα
         420        430        440        450         460        470
FnCpf1   YITQQIAPKNLDNPSKKEQEIAKKTEKAKYLSLETIK.LALEEFNKHRDID
AsCpf1   ................NALYERRISELTGKITKSAKEKVQRSLKHEDINLQEII
Lb3Cpf1  ....DKNNAEYDDIHLKKKAVTEKYEDDRRKSFKKIGSFSLEQLQEYADAD
                                ¯¯¯        ααααα      αααααα           α

αααααααααα          ----                    αααααααααα    αα
         530        540        550        560         570         58
FnCpf1   DLFDQTNNLLHKLKIEHISQSEDKANILDKDEHYYLVFEECYF
AsCpf1   SQFDSLLGLYHLLDWFAVDESN......EVDPEFSARLTGIKL
Lb3Cpf1  DLFDSVKSFENYIKAFFGEGKE.....TNRDESFYGDFVL
         ααααααααααααααααα

αααα          ααααααα       α           --
         640        650        660        670         680
FnCpf1   KNNKIFDDKAIKENKGEGYKKIVKLLGANKVLDVFFSAESIKFYNPSED
AsCpf1   GRYKALSFEPTEKTSEGFDNYIDYFDAAKTIRCSTQLAVTAHFQTHT
Lb3Cpf1  KYAKCLQKIDKDDVNGN.YETNKLLGPNKVLDVFFSKKWMAYYNPSED
         ααααααααα                                   ¯¯¯¯¯¯    αα
```

FIG. 68A

```
                 ꝯꝯꝯꝯꝯꝯꝯꝯꝯꝯꝯꝯꝯꝯ      ꝯꝯꝯꝯꝯꝯꝯꝯꝯꝯꝯꝯꝯꝯ              ꝯ      ꝯꝯꝯꝯꝯꝯꝯꝯꝯꝯꝯ
                       60              70              80              90             100
             IIDKYNQFIEEISSVCISEDLIQNYSDVYFLKKSDDDLQKDFKSAKDTIKKQI
             IIDRIYKTYADQCIQLVQLDWENISAAIDSYREKTEETRI...ALIEEQATYRNAI
             LLRYYLSFINDVIHSIKLKN..INNYISLFRIKTRTEKEI..KELENLEINLRKEI
                 ꝯꝯꝯꝯꝯꝯꝯꝯꝯꝯ  ꝯꝯ                        ꝯꝯꝯꝯꝯ                ꝯꝯꝯ               ꝯꝯꝯꝯꝯꝯꝯꝯꝯꝯꝯꝯꝯꝯ

‒             ꝯꝯꝯꝯꝯꝯꝯꝯꝯꝯꝯ                       ‒‒‒                                                 ‒‒‒‒
             50            160             170             180             190             200
             GIELFKANSDITDIDEALEIIKSIKGWIIYEIGIHEIRKIVYSSNDIPISIIYRIVD
             ..KVLKQLGTVTTTEHENALLRSFDKFIIYSIGIYEIPKIVFSAEDISIAIPHRIVQ
             ......ILPEFLDDKDEIALVNSIGNGEIIAIGIFDIREIMFSEEAKSISIAFICIN
             ........ꝯ ꝯꝯꝯ                      ‒‒‒‒                                                  ꝯ             ꝯꝯꝯꝯꝯ

ꝯꝯꝯꝯꝯ       ꝯꝯꝯ                                              ‒                                 ꝯꝯꝯꝯꝯꝯꝯꝯꝯ      ꝯꝯ
             260           270             280             290             300             310
             FSLDEVIEIANFINYINSGITKFIITIIGGIKFVNGENTIRKIGIIIEYIILYSIQINDK
             ..IEEVSSFPFYIQLITQTQIDLYIQLLGGISREAGTEIIKIGLINEVLILAIIKNDET
             ..VEDFIEGEFIIFVEITIEGIDVYIALIGG.FVTESGEIIKIGLIIEYIILYNIKTKQK
                                                                                                    ꝯꝯꝯꝯꝯꝯꝯꝯꝯ

ꝯꝯꝯꝯꝯꝯꝯꝯꝯꝯꝯꝯꝯꝯꝯꝯꝯꝯꝯ                                                                       ꝯꝯꝯꝯꝯ                             ꝯꝯꝯꝯꝯ
                    370             380             390             400             410
             KTVEEKSIKETILSLIDDLKAQKLDLSKIYFKNDKSLTDLSQQVFDDYSVIGTAVLE
             .LLRNENVLETAEAINELNSIDLT...HIFISHKKLETISSALCDHWDTLR.....
             KNSEIFSSIKKLEKIKNFDEYSS..AGIFVKNGPAISTIKDIFGEWNVIR.....
              ꝯꝯꝯꝯꝯꝯꝯꝯꝯꝯꝯꝯ                                       ‒‒‒‒

ꝯꝯꝯꝯꝯꝯꝯꝯꝯꝯ                  ꝯꝯꝯꝯꝯꝯꝯꝯꝯꝯ      ꝯꝯꝯꝯꝯꝯꝯꝯꝯ                           ꝯꝯꝯꝯꝯꝯꝯꝯꝯꝯꝯꝯꝯ
                    480             490             500             510             520
             KQCRFEEILANFAAIPNIFDEIAQNKDNLAQISIKYQNQGKKDLLQASAEDDVKAI
             SAAGKELSEAFKQKTSEILSHAHAALDQPLPTTLKKQ.............EEKEIL
             LSVVEKLKEIIIQKVDEIYKVYGSS.EKLFDADFVLEKSLKK......NDAVVAIN
              ꝯꝯꝯꝯꝯꝯꝯꝯꝯꝯꝯꝯꝯꝯ                                     ꝯꝯꝯꝯꝯꝯꝯ          ꝯꝯꝯꝯꝯꝯꝯ

ꝯꝯꝯꝯꝯꝯ
             0             590             600             610             620             630
                          DEIFKINIFNSTLANGIDKNKEPDNTIILPIKDDKIIGVINK.
                          VEIFIINIQNPTLASGIDVNKIKNKGAILFNKNGLIIGIIPIQ
                          KDIFIYIQNPQPMGGIDKDKITDYRITILRYGSKIAINDI.
                                                  ‒                                         ꝯꝯꝯꝯꝯ           ꝯꝯꝯꝯ

ꝯꝯꝯꝯꝯꝯꝯꝯꝯꝯ
             690           700                             710             720
             ILRIRNHSTHTKNGSPQKGYEK.............FEFNIEDCRIIY
             TPILLSNNFIEPLEITKEIYDLNNPEKEPKKFQTAYAKKTGDQKGYREALCIWIT
             IQKIYKNGTFKKGD......................MFNLNDCHILIIF
              ꝯꝯꝯꝯ                                                                            ꝯꝯꝯꝯꝯꝯ
```

FIG. 68A (Cont.)

```
                    ΩΩ                       ΩΩΩΩΩΩΩΩ
                    840                  850
FnCpf1    RKQSIPRK..ITHPAKEAIANRNKDNPRK..................
AsCpf1    RPKRMRR..MAHRLGEKMLIRKLKDQRTPIPDTLYQELYDVNHRLSHDL
Lb3Cpf1   RRRSLKEELVVRPANSPIANRNPDNPRK..................
          ΩΩΩΩΩ          ——
```

RuvC I

```
             ΩΩ                 ———             ———           —
             910      920      930      940      950
FnCpf1    REKANDVHILSIDRGERHLAYTLVDGKGNIIKQDTFNITGND....RMKT
AsCpf1    REHPE.TPIIGIDRGERNLIITVIDSTGKILEQRSLNTIQQF........
Lb3Cpf1   RHDDN.PYVIGIDRGLNNLLIVVVDGKGNIVEQYSLNEIINNFNGIKIKT
                                                 ΩΩΩΩ         — —
```

RuvC II

```
                     ΩΩΩΩΩΩΩΩΩΩΩΩΩ
             1010       1020       1030       1040       1050       106
FnCpf1    FGEKRGR.FKVEKQVYQKTEKMLIRKLYLVFKDNEFDKTGGVLRAYQLTA
AsCpf1    FGEKSKRTGIAERAVYQQFEKMLIDKLCLVLKDYPAEKVGGVLNPYQLTD
Lb3Cpf1   SGFKNSR.VKVEKQVYQKFEKMLIDKLYMVDKKSNPCATGGALKGYQIEN
                    ΩΩΩΩΩΩΩΩΩΩΩΩΩΩΩΩΩ                       — —
```

Zn Finger-like

```
                    ——                                          ————
             1120       1130                      1140        1
FnCpf1    RNLDKGYREFSFDY................KNRG..DKAAKGRWTIASF
AsCpf1    RDVKTGDRILHFKMNRNLSFQRGLPGFMPAWDIVREKNETQFDARGTPFIA
Lb3Cpf1   RVPEEDLREFALDY.......................KNRSRTDADYIKRWKLYSY
          ΩΩΩΩΩΩΩΩΩΩ                                ΩΩΩΩΩΩΩΩΩΩ
```

RuvC III

```
                 ΩΩΩΩΩΩΩΩΩΩΩΩΩ
             1210       1220       1230       1240       1250
FnCpf1    KLTSVLNTILOMRLSKTG.RELDYLISPVADVNGNFFDSR....QAPKNMP
AsCpf1    TMVALIRSVLOMRLSNAA.RGEDYLISPVRDLNGVCFDSR....FQNPENR
Lb3Cpf1   SFMALMSLMLOMRLSITGRRDVDFLISPVKNSDGIFYDSRNYEAQENAILP
          ΩΩΩΩΩΩΩΩΩΩΩΩΩΩΩ                        ΩΩΩΩΩΩ
```

FIG. 68B

```
                                                       ────        ooooooo
          860        870       880       890       900
..........ESVFEYDLIKDKRFEDKFFFCPITINFKSSG.ANKFKDEINLL
SDEARALLPNVITKEVSHEIILDRRFTSDKFFFVPITLIYQAANSPSKFQRVNAYL
..........TTTLSYDVYKDKRFSEDQYELIIBIAINKCPKN.IFKINTEVRVLL
                                                    Ω   Ω
          Bridge Helix                           RuvC II oooooooooo     oooooooooo    ooooo    ooooooooooooo    ─────
     960           970          980         990       1000
NIHDKLAAIEKDRDSARKDWKKINNIIEMREGTLSQVVHEAKIVIETNAIVVFEDL
DIQKKLDNREKERVAARQAWSVVGTIIDLKQGTLSQVIHETVDKMIHTQAVVVLENI
DIHSLIDKKERFPEARQNTSIENIKELIAGTISQVVEKICELVEKIDAVIALEDL
          Ω  oooooooooo    oooooooooo    ooooooooooooo oooo               ─────        ─                     oooo
0        1070       1080       1090        1100       1110
PFETIKKMGKQTGIIYYVPAGFTSIICPVTGFVN.QLYPKYESVSKSQEFFSKIDKTC
QTSFAKMGTQSGFLFIVPAPYTSIIDPLTGFVDPFVWKTIKNHESRKHFLEGFDFLH
KFESFKSMSTQNGFIFIIPAWLTSIIDPSIGFVN.LLKTKYTSIADSKKFISSIDRIM
                    ─────                                 ─  ─

──                            ooooooo         ooooo  Ω  ooooo
    150       1160       1170       1180       1190       1200
GSKLINFRNSDKNHNWDTREVYPTKELEKILKDYSIEYGHCECKKAAICGESDKKFFA
GKRIVPVIENHR.FTGRYRDLYPANELIAILEEKGIVFRDCSNILPKLLENDDSHAID
CNRIRIFRNPKKNNVFDWEEVCLTSAYKELFNKYGINYQQGD.IRALLCEQSDKAFYS
 ──                                        oooooooooo    ooooooo   ooooo Ω                                   ───      oooooo
          1260       1270       1280       1290       1300
QDADANCAIHIGLEGLMLIGRINNQEGK..KLNLVIKIEEYFEFVCNRNN.
MDADANCAIHIALGQLLLNHLKESKDLK...LQNGISLQDWLAYIQELRN.
KNADANCAINIARVLWAIGQFKKAEDERLDKVKIASSKEWLEYACTSVKH
      oooooooooooooooooooooo              oooooooooo
```

FIG. 68B (Cont.)

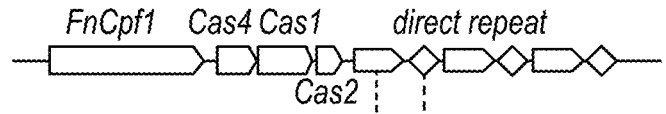
1- *F. tularensis* subsp. *novicida* U112 (NC_008601)
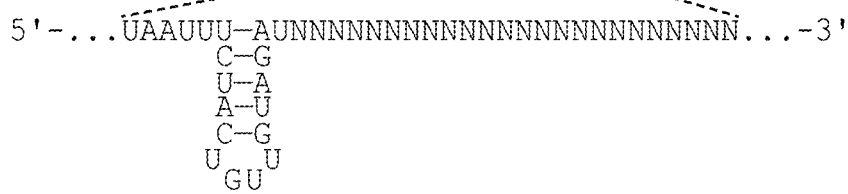
2- *L. bacterium* MC2017 (NZ_KL370807)
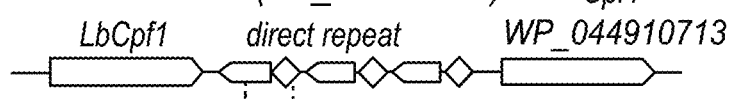
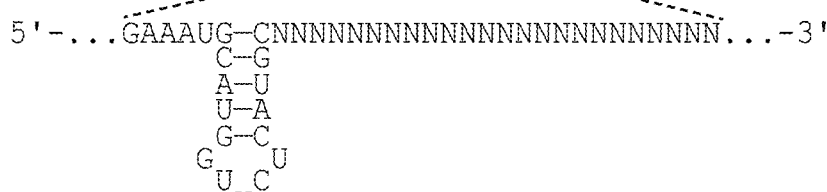
3- *B. proteoclasticus* (NC_014383)
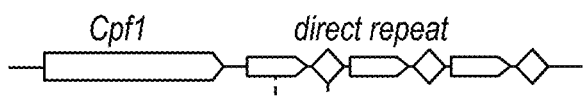
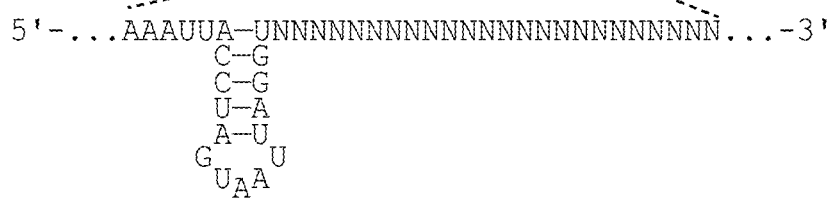
4- *P. bacterium* GW2011_GWA_33_10 (LBOO01000015)
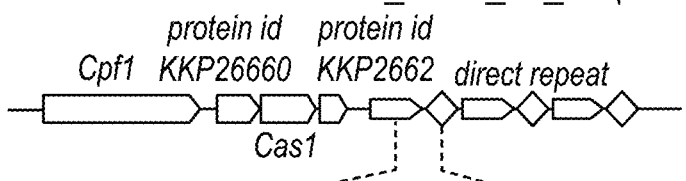
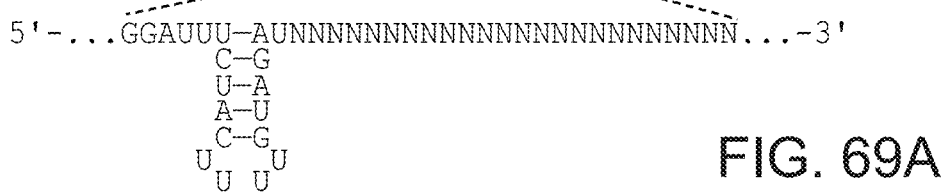
FIG. 69A

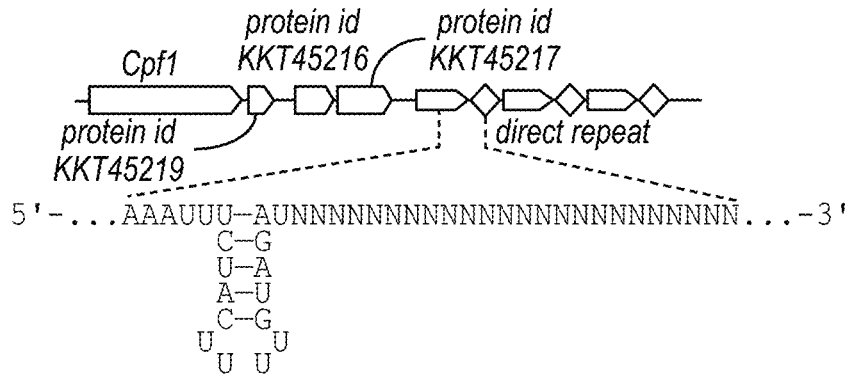
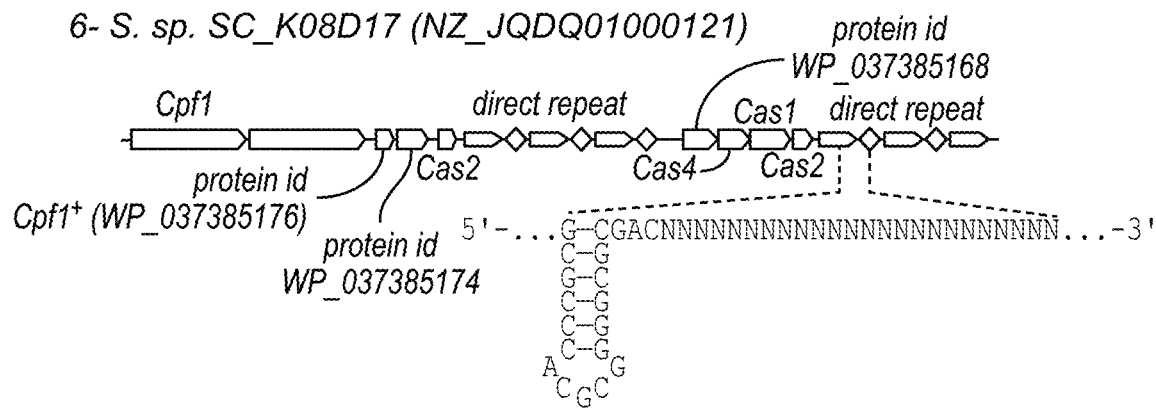
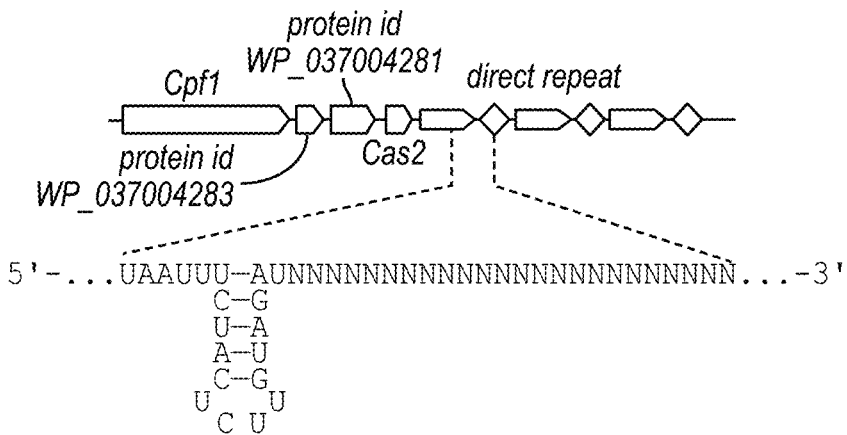
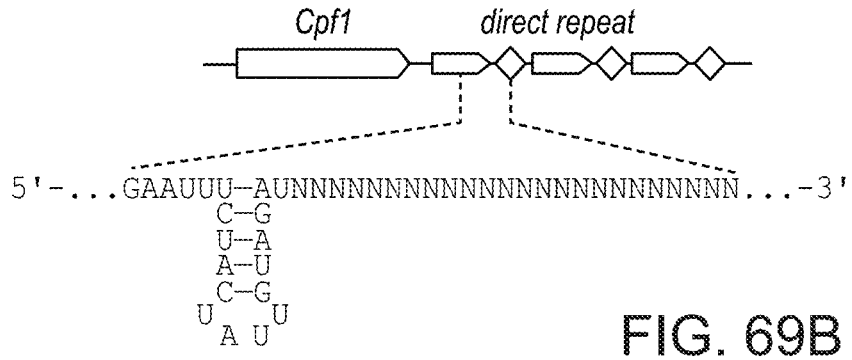
FIG. 69B

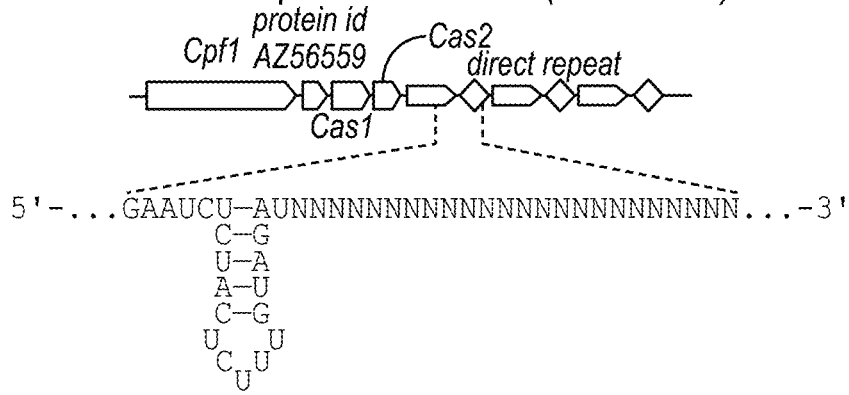
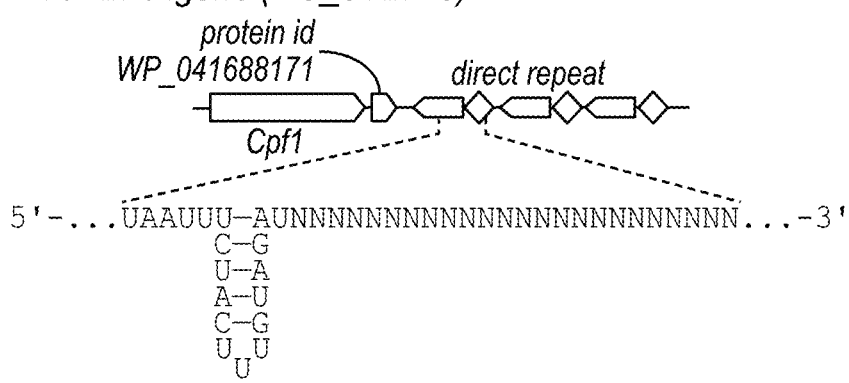
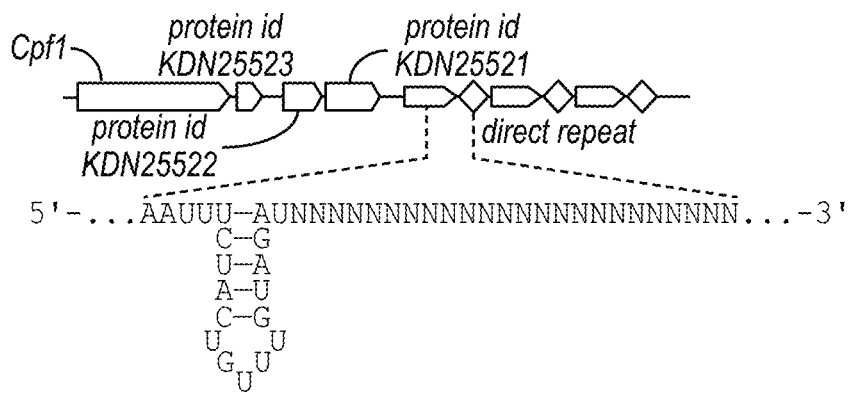
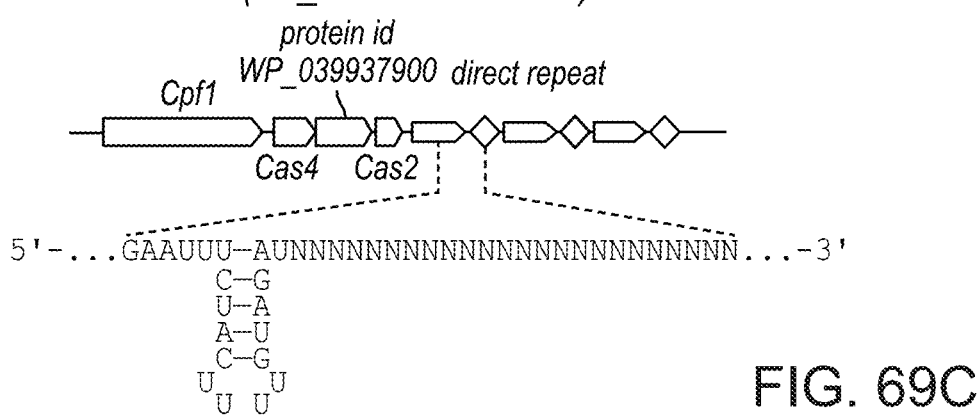
FIG. 69C

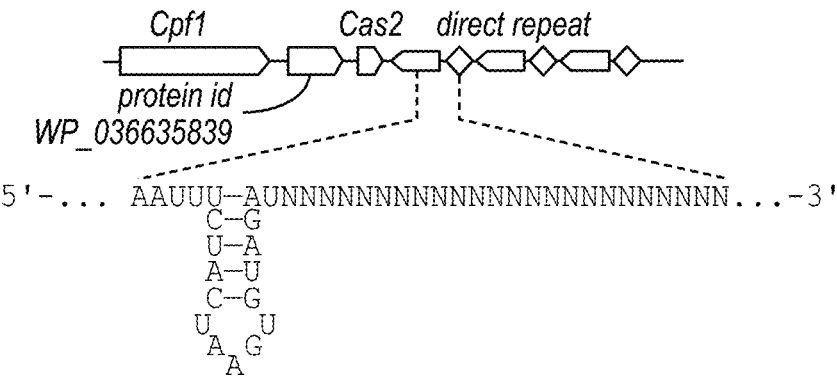
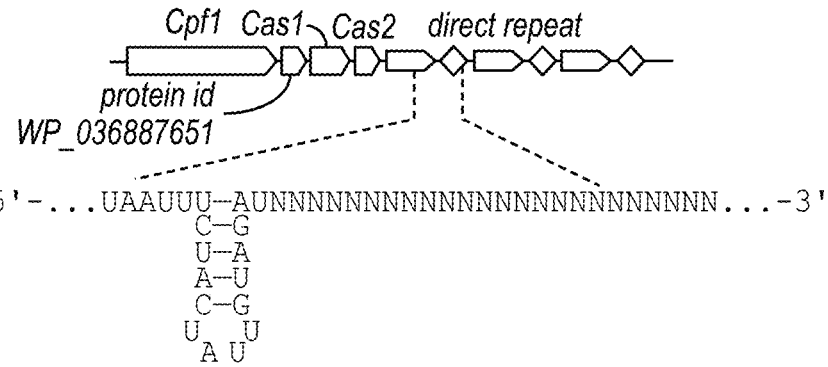
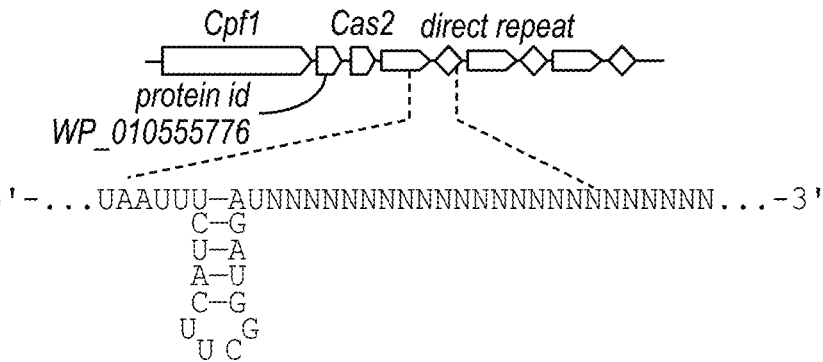
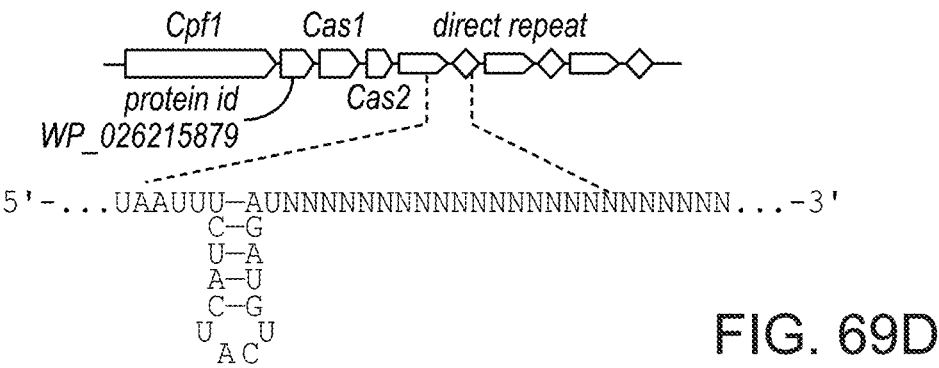
FIG. 69D

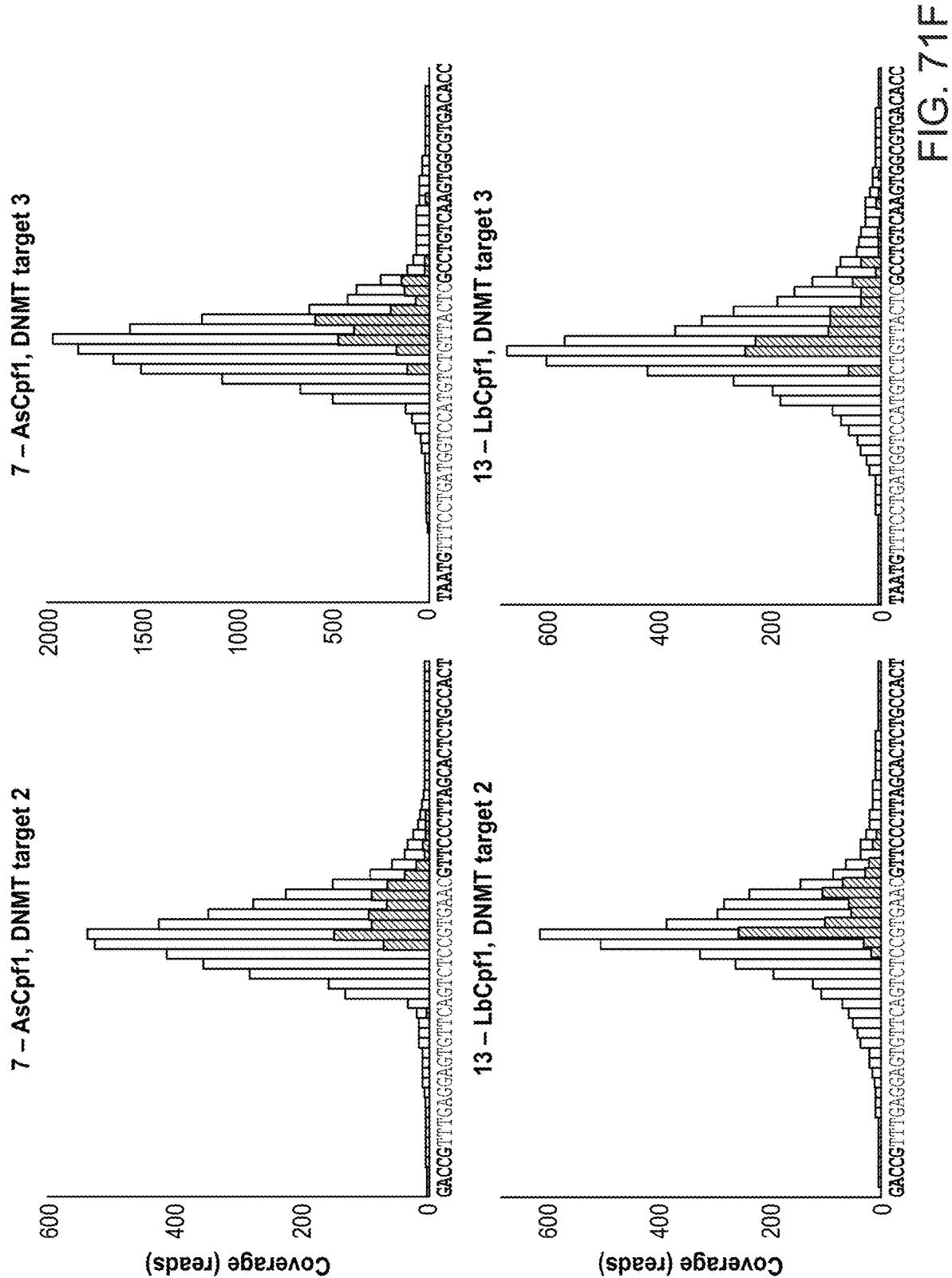

```
         80        90       100       110       120       130
         |         |         |         |         |         |
         EMLSAAIDSTRKEKTEETRNALIKEQATYRNAIHDYFIGRTDMLTDAIKKKHAYIYKG 210       220       230       240       250       260
         |         |         |         |         |         |
         CNEETRLIKIAMPGLRENFENVXKAIGIKVSTGIKKVFSFFFYXQLLTQTQIDLYKQLL
         DIMXQSGXXXVXEGP 340       350       360       370       380       390
         |         |         |         |         |         |
                  Rad50 DNA binding Domain
         YKTLLXXENVLMTAEALFNELMSIDLTMIPISNKKLETISSALCDHMDTLKKALYIRR 470       480       490       500       510       520
         |         |         |         |         |         |
                  Rad50 DNA binding Domain
         LKSQIDSLLGLYHLLDMFAVDESMEVDFEFSAHLTGLIKLEKPSLSFYNKAKKYAYXX 600       610       620       630       640       650
         |         |         |         |         |         |
         FPDAAXMIPKCSTQLKAVTAHFXTMTTPIXXLXKKFIERLGXXXKIXIDLNNPEKEPKKF
                           ----FXXGXXXIXGXVFQG
```

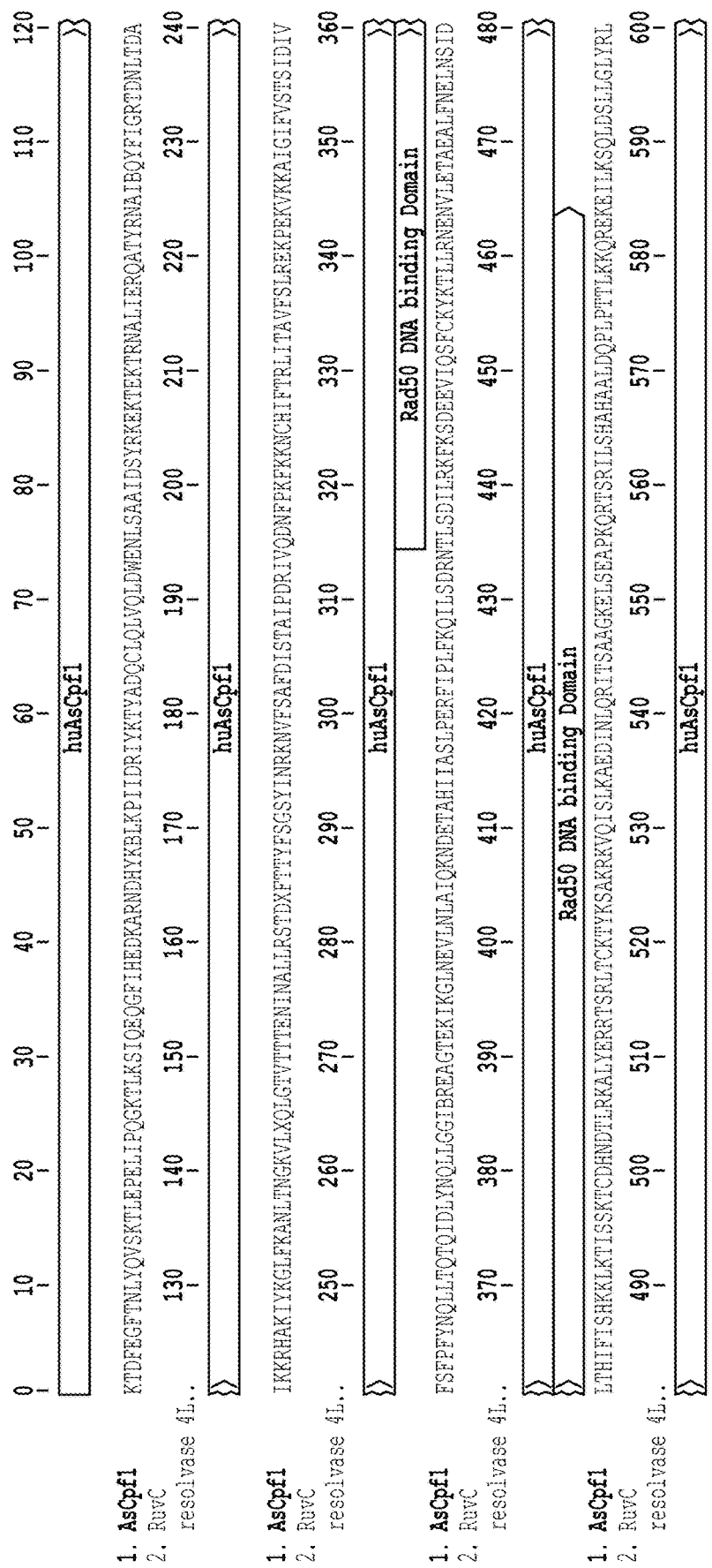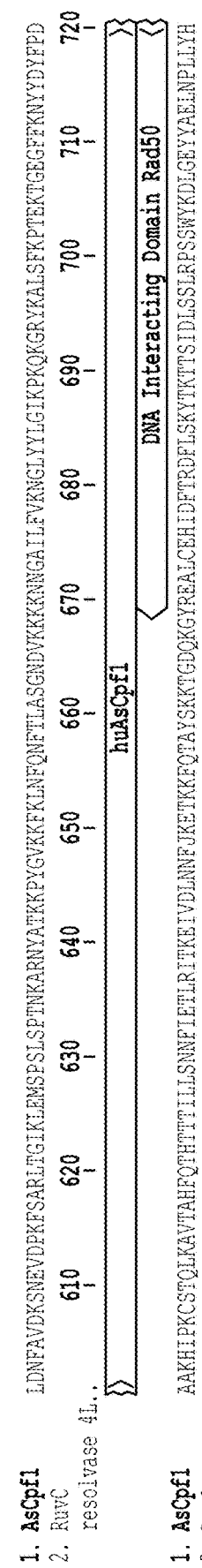
FIG. 73C

```
                    0         10        20        30
                    |         |         |         |

1. AsCpf1   KTQFECPIKLYQVSKTLRFELIPQCKTLKHIQEQC
2. FnCpf1   KSTYQEFVNKYSLSKTLRFELIPQGKTLENIKARG 130       140       150       160
            |         |         |         |

1. AsCpf1   LIDAINKRKAEITKGLFKAELFLGKVLKQLGTVTT
2. FnCpf1   LIDAKKGQESDLILMLKQSKDNGIELFKANSDITD

Shufn2
           260       270       280
            |         |         |

1. AsCpf1   -------SIERVFSFPFYNQLLIQTQIDLYNQLLG
2. FnCpf1   EVNQRVFSLDRVFEIANFNNTLNQSGITKFNTIIG 380       390       400       410
            |         |         |         |

1. AsCpf1   AEALFNELNS--IDLTHIFIS-HKKLKTISSALCD
2. FnCpf1   LSLLFDDLKAQKLDISKIYFKNDKSLTDLSQQVFD 510       520       530
            |         |         |
                Rad50 DNA binding Domain
1. AsCpf1   LPTTLKKQ-------------EEKEILKSQLDSSL
2. FnCpf1   AQISIKYQNQGKKDLLQASAEDDVKAIKDLLDQTN 640       650       660
            |         |         |

1. AsCpf1   GLYYLGIMPKQKGRYKALSFKPTRKTSEGFDKNTY
2. FnCpf1   DKYYLGVMNK-KNNKIFDDKAIKRNKGEGYKKIVY

```
            40        50        60        70        80
                              huAsCpf1
FIEEDKARNDHYKELKPIIDRIYKTYADQCLQLVQLDWENLSAAIDSYRKE
LILDDEKRAKDYKKAKQIIDKTHQFFIEEILSSVCISEDLLQNYSDVYFKL
                           H_pcDNA3.1(+)
       Shufn1

170       180       190       200       210
                              huAsCpf1
TEHKKALLRSFDKFTTYFSGFYENRKNVFSAKDISTAIPHRIVQDNFPKFK
IDEALEIIKSFKGWTTYFKGFHENRKNVYSSNDIPTSIIYRIVDDNLPKFL
                           H_pcDNA3.1(+)

290       300       310       320       330
                              huAsCpf1
GISREAGTEKIKGLNEVLNIAIQKNDETAHIIASLPHRFIPLFKQILSDRN
GKFVNGENTKRKGINEYINLYSQQINDKT----LKKYKKSVLFKQILSDTE
                           H_pcDNA3.1(+)
                                              Shufn3

420       430       440       450       460
                              huAsCpf1
                        Rad50 DNA binding Domain
HWDTLRNALYERRISKLTGK-------------ITKSAKEKVQRSLKUEDIN
DYSVIGTAVLEYITQQIAPKNLDNPSKKEQELIAKKTEKAKYLSLETIKLA
                           H_pcDNA3.1(+)

540       550       560       570       580       590
                              huAsCpf1
GLYHLLDWFAVDESNE------VDPEFSARLTGIKLEMEPSLSFYNKARNY
NLLHKLKIFHISQSEDKANILDKDEHETLVFEEGYFELANIVPLYNKIRNY
                           H_pcDNA3.1(+)

670       680       690       700       710
                              huAsCpf1
DYFPDAAKMIPKCSTQLKAVTAXFQTKTTPILLSNNFIKPLKITKKIYDLN
KLLPGANKMLPKVFFSAKSIKFYNPSEDLRIRN--------------HSTH
                           H_pcDNA3.1(+)
```

```
           90         100        110        120
            |          |          |          |

K---TEETRNALIEEQATYRNAISDYFIGR-------TDN
KKSDDDKLQKDFKAKDTIKKQISEYIKDSEKFKNLFNQN 220        230        240        250
            |          |          |          |

ENCHIFTRLITAVPSLREHFENVKKAIGUFVST--------
ENKAKYESLKDKAP-EAINYEQIKKDLAKELTFDIDYKTS 340        350        360        370
       |          |          |          |

Rad50 DNA binding Domain
TLSFILEEFKSDEEVIQSPCKYKTLLR------NENVLRT
SKGFVIDKLEDDSDVVTTMQSFYEQIAAFXTVEEKSIKRT 470        480        490        500
         |          |          |          |

LQKIISAAGKELSEAFKQKTS------EILSHAHAALDQP
LFEFNKHRDIDKQCRFEEILANFAAIPNIPDEIAQNKDNL
                                    Shufn9

600        610        620        630
            |          |          |          |

ATKKPYSVEKPKLNFQNPTLASGWDVNKEKNNGAILFVKN
ITQKPYSQEKFKLNFENSTLANGWDKNKEPDNTAILFIKD 720        730        740        750
          |          |          |          |

DNA interacting domain Rad50
NPKKKPKKFQTAYAKKTGDQKGTRKALCKWIDFTRDFLSK
TKNGSPQKGYRJFEFNIRDCR------KFIDFYKQSISK
```

FIG. 73D (Cont. 2)

```
                       760        770        780        790
                                   DNA interacting domain Rad50
1. AsCpf1    YTKTTSIDLDDLRPSSQYKDLGEYYAELNPLLYBISFQRIAE
2. FnCpf1    HPEWKDFGFR-FSDTORYNSIDEFYREVENOGYKLTFENISE 890        900        910        920

1. AsCpf1    DQKTPIPDTLYQELYDVVMBRLSHDLSDEARALLPNVITKEV
2. FnCpf1    NPKK------------------------------------ESVF 1,010     1,020      1,030     1,040      1,050

1. AsCpf1    ---QPDYQKKLDNKRKERVAARQAWSVVGTIKDLKQGYLSQV
2. FnCpf1    DRMKTNYHDKLAAIRKDRDSARKDWKKINNIKEMKEGYLSQV 1,140      1,150      1,160     1,170
             RuvC
1. AsCpf1    GFLFYVPAPYTSKIDPLTGFVDPFVWKTIKNHESRKHFLEGF
2. FnCpf1    GIIYYVPAGFTSKICPVTGFVN-QLYFKTESVSKSQKFFSKF

Shufa7
                  1,270      1,280     1,290      1,300

1. AsCpf1    LIEEKGIVFRDGSNILPKLLENDDSHAIDTMVALIRSVLQMR
2. FnCpf1    LLKDTSIEYGHGECIKAAICGESDKKFFAKLTSVLNTILQMR
```

FIG. 73E

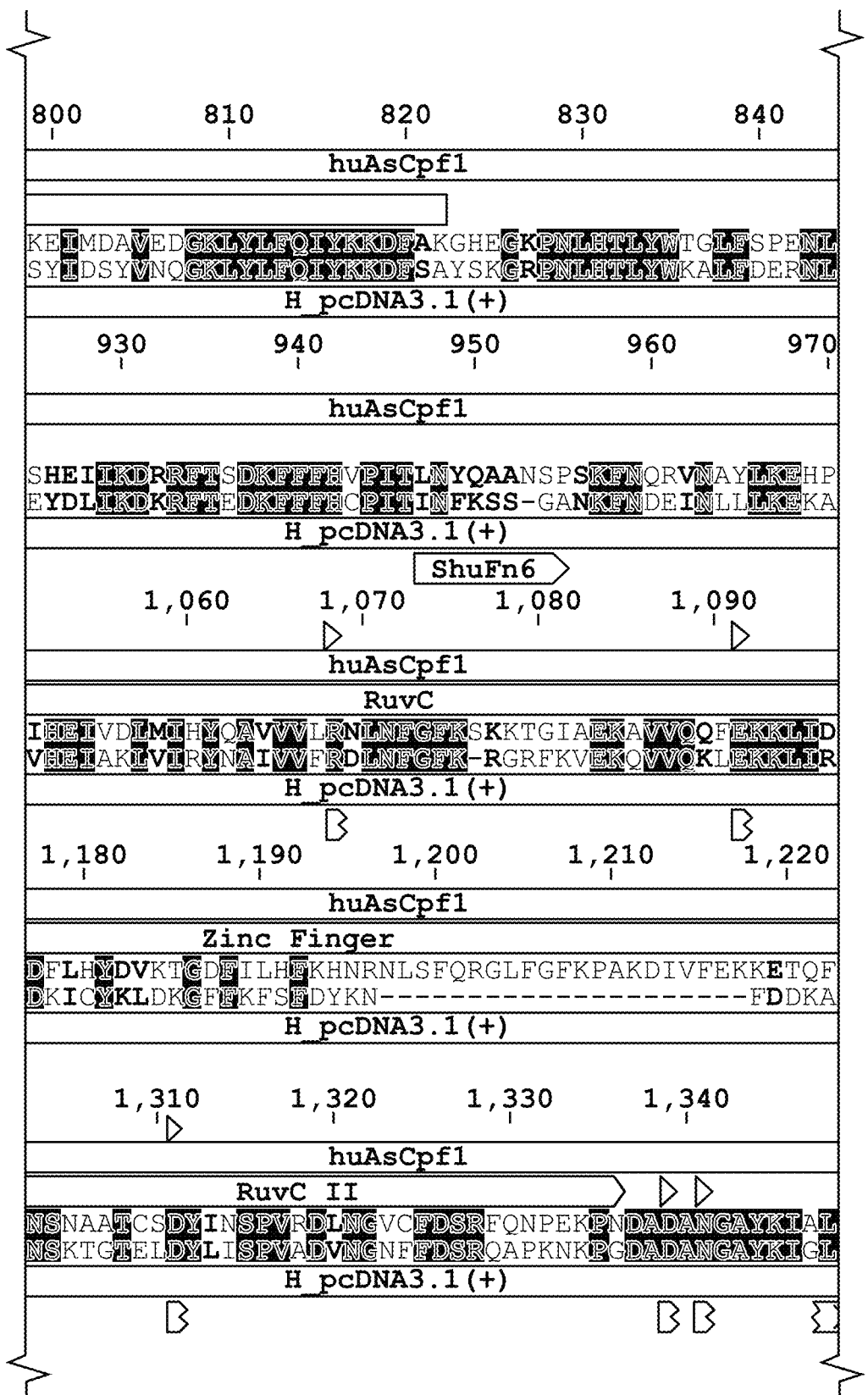
FIG. 73E (Cont. 1)

```
                    850         860         870         880
                     |           |           |           |

AKTSIKLNGQAELFYRPKSRMXRMAHRLGEKMLNXKLK
ODVVTKLNGEAKLFYRKQSIPXKITHPAKEAIANXNKD 980         990       1,000
                               |           |           |

RuvC
-ETPIICIDRGERNLIYITVIDSTGKILEQASLNTIQ-
NDVHILSIDAGERHLAYYTLVDGKGKIIKQDTFNIIGN 1,100       1,110       1,120       1,130
       |           |           |           |

KLNCLVLKDYFAEKVGGVLNFYQLTDQFTSFAKMGTQS
KLNYLVFKDKEFDKTGGVLRAYQLTAPFETFKKMGKQT 1,230       1,240       1,250       1,260
             |           |           |           |

DAKGTFFIAGKRIVPVISNHR-FTGRTRDLYFAKKLIA
KGKKTIASFGSRLINFRKSDKNNKDRRRVYFTKKLKK 1,350       1,360       1,370       1,380   1,384
       |           |           |           |       |

KGQLLLNHLKESKD-LKLQNGISNQDWLAYIQELRN
KGLKILGRIKKNQEGKKLNLVIKNEETFEFVQNRNN
```

FIG. 73E (Cont. 2)

Site-specific recombinase XerD [Roseburia intestinalis M50/1]
Sequence ID: emb|CBL10059.1| Length: 416 Number of Matches: 1

Range 1: 175 to 292 Genpept Graphics

| Score | Expect | Method | Identities | Positives | Gaps |
|---|---|---|---|---|---|
| 46.2 bits(108) | 0.14 | Compositional matrix adjust. | 42/127(33%) | 59/127(46%) | 17/127(13%) |

```
Query  750  PAKGHEGKP-----NLHTLYWYGLFSPENLAKTSIKLWGQAELFYRPKSRMKMAARLGEK  803
            P +G    KP         L+ G+          E LA +        + +   R+G K
Sbjct  175  PRCGVEDKPLSYICFEVLYWYGNRECELLALSPADIDNKLI-----SINRTYQRICGK  229

Query  806  NLMKHLKDQKT-----PIPDTLYQELYDYVNRLSHDLSDEARALLPNVITKEVSHETIKD  861
             +    K  K+      PIPD L QEL DY+  R  D +DE        L P V    +SHE+I+
Sbjct  230  DVFTSPKTRKSKKTIPIPDFLCQELSDYIQSRYMLD-ADE---RLFP-VTKSYLSHEMIRG  285

Query  862  RKFTSDK  868
             +  + K
Sbjct  286  CKITCAK  292
```

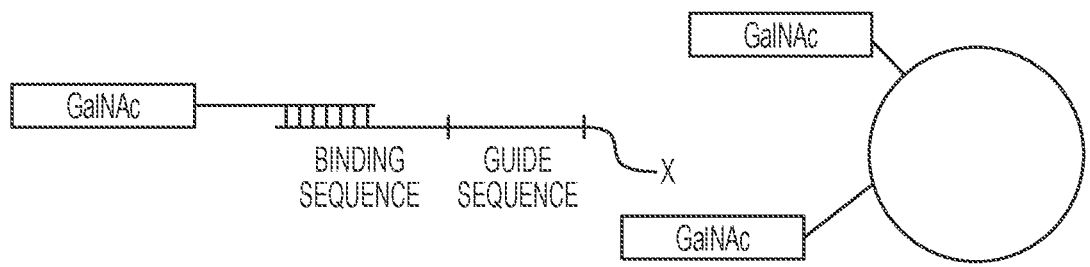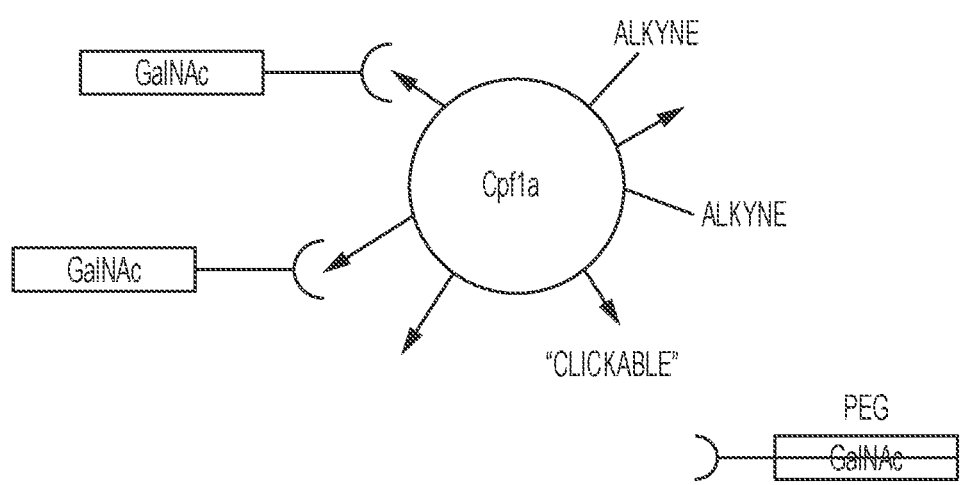
FIG. 80

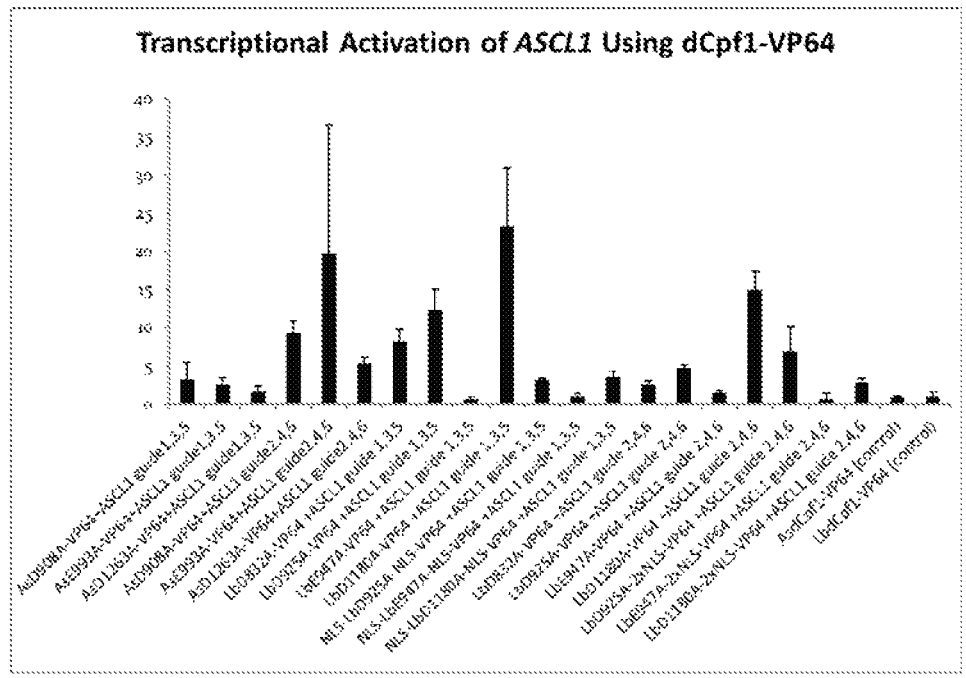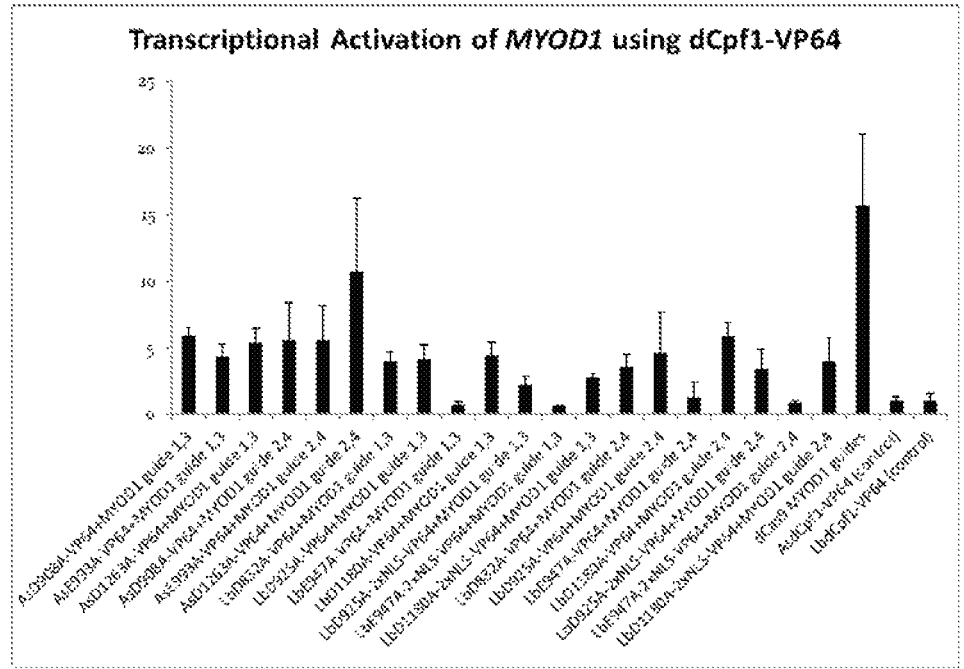
FIG. 81A

CRISPR ENZYMES AND SYSTEMS

CROSS-REFERENCE TO RELATED APPLICATIONS

This application is the National Phase of International Patent Application No. PCT/US2016/067201, filed Dec. 16, 2016, published on Jun. 22, 2017 as WO 2017/106657 A1, which claims priority to U.S. Provisional Application No. 62/269,860, filed Dec. 18, 2015 and to U.S. Provisional Application No. 62/324,811, filed Apr. 19, 2016. The contents of these applications are herein incorporated by reference in their entirety.

INCORPORATION BY REFERENCE

Reference is made to U.S. Provisional 62/181,739, filed on Jun. 18, 2015; U.S. Provisional 62/193,507, filed on Jul. 16, 2015, U.S. Provisional 62/201,542, filed Aug. 5, 2015, U.S. Provisional 62/205,733, filed Aug. 16, 2015, U.S. Provisional 62/232,067, filed Sep. 24, 2015, U.S. application Ser. No. 14/975,085, filed Dec. 18, 2015, and International PCT application PCT/US2016/038181, filed Jun. 17, 2016.

The foregoing applications, and all documents cited therein or during their prosecution ("appln cited documents") and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

STATEMENT AS TO FEDERALLY SPONSORED RESEARCH

This invention was made with government support under Grant Nos. MH100706 and MH110049, awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy, created on Apr. 10, 2019, is named 114203-1037_SQL.txt and is 2,033 kilobytes in size.

FIELD OF THE INVENTION

The present invention generally relates to systems, methods and compositions used for the control of gene expression involving sequence targeting, such as perturbation of gene transcripts or nucleic acid editing, that may use vector systems related to Clustered Regularly Interspaced Short Palindromic Repeats (CRISPR) and components thereof.

BACKGROUND OF THE INVENTION

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome engineering technologies that employ novel strategies and molecular mechanisms and are affordable, easy to set up, scalable, and amenable to targeting multiple positions within the eukaryotic genome. This would provide a major resource for new applications in genome engineering and biotechnology.

The CRISPR-Cas systems of bacterial and archaeal adaptive immunity show extreme diversity of protein composition and genomic loci architecture. The CRISPR-Cas system loci has more than 50 gene families and there is no strictly universal genes indicating fast evolution and extreme diversity of loci architecture. So far, adopting a multi-pronged approach, there is comprehensive cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multisubunit effector complexes and Class 2 with single-subunit effector modules exemplified by the Cas9 protein. Novel effector proteins associated with Class 2 CRISPR-Cas systems may be developed as powerful genome engineering tools and the prediction of putative novel effector proteins and their engineering and optimization is important.

Citation or identification of any document in this application is not an admission that such document is available as prior art to the present invention.

SUMMARY OF THE INVENTION

There exists a pressing need for alternative and robust systems and techniques for targeting nucleic acids or polynucleotides (e.g. DNA or RNA or any hybrid or derivative thereof) with a wide array of applications. This invention addresses this need and provides related advantages. Adding the novel DNA or RNA-targeting systems of the present application to the repertoire of genomic and epigenomic targeting technologies may transform the study and perturbation or editing of specific target sites through direct detection, analysis and manipulation. To utilize the DNA or RNA-targeting systems of the present application effectively for genomic or epigenomic targeting without deleterious effects, it is critical to understand aspects of engineering and optimization of these DNA or RNA targeting tools.

The invention provides a method of modifying sequences associated with or at a target locus of interest, the method comprising delivering to said locus a non-naturally occurring or engineered composition comprising a Type V CRISPR-Cas loci effector protein and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprises DNA and the effector protein is a Cpf1 enzyme.

It will be appreciated that the terms Cas enzyme, CRISPR enzyme, CRISPR protein Cas protein and CRISPR Cas are generally used interchangeably and at all points of reference herein refer by analogy to novel CRISPR effector proteins further described in this application, unless otherwise apparent, such as by specific reference to Cas9. The CRISPR effector proteins described herein are preferably Cpf1 effector proteins.

The invention provides a method of modifying sequences associated with or at a target locus of interest, the method comprising delivering to said sequences associated with or at the locus a non-naturally occurring or engineered composition comprising a Cpf1 loci effector protein and one or more nucleic acid components, wherein the Cpf1 effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment the Cpf1 effector protein forms a complex with one nucleic acid component; advantageously an engineered or non-naturally occurring nucleic acid component. The induction of modification of sequences associated with or at the target locus of interest can be Cpf1 effector protein-nucleic acid guided. In a preferred embodiment the one nucleic acid component is a CRISPR RNA (crRNA). In a preferred embodiment the one nucleic acid component is a mature crRNA or guide RNA, wherein the mature crRNA or guide RNA comprises a spacer sequence (or guide sequence) and a direct repeat sequence or derivatives thereof. In a preferred embodiment the spacer sequence or the derivative thereof comprises a seed sequence, wherein the seed sequence is critical for recognition and/or hybridization to the sequence at the target locus. In a preferred embodiment, the seed sequence of a FnCpf1 guide RNA is approximately within the first 5 nt on the 5' end of the spacer sequence (or guide sequence). In a preferred embodiment the strand break is a staggered cut with a 5' overhang. In a preferred embodiment, the sequences associated with or at the target locus of interest comprise linear or super coiled DNA.

Aspects of the invention relate to Cpf1 effector protein complexes having one or more non-naturally occurring or engineered or modified or optimized nucleic acid components. In a preferred embodiment the nucleic acid component of the complex may comprise a guide sequence linked to a direct repeat sequence, wherein the direct repeat sequence comprises one or more stem loops or optimized secondary structures. In a preferred embodiment, the direct repeat has a minimum length of 16 nts and a single stem loop. In further embodiments the direct repeat has a length longer than 16 nts, preferrably more than 17 nts, and has more than one stem loop or optimized secondary structures. In a preferred embodiment the direct repeat may be modified to comprise one or more protein-binding RNA aptamers. In a preferred embodiment, one or more aptamers may be included such as part of optimized secondary structure. Such aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

The invention provides methods of genome editing wherein the method comprises two or more rounds of Cpf1 effector protein targeting and cleavage. In certain embodiments, a first round comprises the Cpf1 effector protein cleaving sequences associated with a target locus far away from the seed sequence and a second round comprises the Cpf1 effector protein cleaving sequences at the target locus. In preferred embodiments of the invention, a first round of targeting by a Cpf1 effector protein results in an indel and a second round of targeting by the Cpf1 effector protein may be repaired via homology directed repair (HDR). In a most preferred embodiment of the invention, one or more rounds of targeting by a Cpf1 effector protein results in staggered cleavage that may be repaired with insertion of a repair template.

The invention provides methods of genome editing or modifying sequences associated with or at a target locus of interest wherein the method comprises introducing a Cpf1 effector protein complex into any desired cell type, prokaryotic or eukaryotic cell, whereby the Cpf1 effector protein complex effectively functions to integrate a DNA insert into the genome of the eukaryotic or prokaryotic cell. In preferred embodiments, the cell is a eukaryotic cell and the genome is a mammalian genome. In preferred embodiments the integration of the DNA insert is facilitated by non-homologous end joining (NHEJ)-based gene insertion mechanisms. In preferred embodiments, the DNA insert is an exogenously introduced DNA template or repair template. In one preferred embodiment, the exogenously introduced DNA template or repair template is delivered with the Cpf1 effector protein complex or one component or a polynucleotide vector for expression of a component of the complex. In a more preferred embodiment the eukaryotic cell is a non-dividing cell (e.g. a non-dividing cell in which genome editing via HDR is especially challenging). In preferred methods of genome editing in human cells, the Cpf1 effector proteins may include but are not limited to FnCpf1, AsCpf1 and LbCpf1 effector proteins.

In such methods the target locus of interest may be comprised in a DNA molecule in vitro. In a preferred embodiment the DNA molecule is a plasmid.

In such methods the target locus of interest may be comprised in a DNA molecule within a cell. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

In a preferred embodiment, the target locus of interest comprises DNA.

In such methods the target locus of interest may be comprised in a DNA molecule within a cell. The cell may be a prokaryotic cell or a eukaryotic cell. The cell may be a mammalian cell. The mammalian cell many be a non-human mammal, e.g., primate, bovine, ovine, porcine, canine, rodent, Leporidae such as monkey, cow, sheep, pig, dog, rabbit, rat or mouse cell. The cell may be a non-mammalian eukaryotic cell such as poultry bird (e.g., chicken), vertebrate fish (e.g., salmon) or shellfish (e.g., oyster, claim, lobster, shrimp) cell. The cell may also be a plant cell. The plant cell may be of a monocot or dicot or of a crop or grain plant such as cassava, corn, sorghum, soybean, wheat, oat or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus *Lactuca*; plants of the genus *Spinacia*; plants of the genus *Capsicum*; cotton, tobacco, asparagus, carrot, cabbage, broccoli, cauliflower, tomato, eggplant, pepper, lettuce, spinach, strawberry, blueberry, raspberry, blackberry, grape, coffee, cocoa, etc).

In any of the described methods the target locus of interest may be a genomic or epigenomic locus of interest. In any of the described methods the complex may be delivered with multiple guides for multiplexed use. In any of the described methods more than one protein(s) may be used.

In preferred embodiments of the invention, biochemical or in vitro or in vivo cleavage of sequences associated with or at a target locus of interest results without a putative transactivating crRNA (tracr RNA) sequence, e.g. cleavage by an AsCpf1, LbCpf1 or an FnCpf1 effector protein. In other embodiments of the invention, cleavage may result with a putative transactivating crRNA (tracr RNA) sequence, e.g. cleavage by other CRISPR family effector proteins, however after evaluation of the FnCpf1 locus, Applicants concluded that target DNA cleavage by a Cpf1 effector protein complex does not require a tracrRNA. Applicants determined that Cpf1 effector protein complexes comprising only a Cpf1 effector protein and a crRNA (guide RNA comprising a direct repeat sequence and a guide sequence) were sufficient to cleave target DNA.

In any of the described methods the effector protein (e.g., Cpf1) and nucleic acid components may be provided via one or more polynucleotide molecules encoding the protein and/or nucleic acid component(s), and wherein the one or more polynucleotide molecules are operably configured to express the protein and/or the nucleic acid component(s). The one or more polynucleotide molecules may comprise one or more regulatory elements operably configured to express the protein and/or the nucleic acid component(s). The one or more polynucleotide molecules may be comprised within one or more vectors. The invention comprehends such polynucleotide molecule(s), for instance such polynucleotide molecules operably configured to express the protein and/or the nucleic acid component(s), as well as such vector(s).

In any of the described methods the strand break may be a single strand break or a double strand break.

Regulatory elements may comprise inducible promotors. Polynucleotides and/or vector systems may comprise inducible systems.

In any of the described methods the one or more polynucleotide molecules may be comprised in a delivery system, or the one or more vectors may be comprised in a delivery system.

In any of the described methods the non-naturally occurring or engineered composition may be delivered via liposomes, particles (e.g. nanoparticles), exosomes, microvesicles, a gene-gun or one or more vectors, e.g., nucleic acid molecule or viral vectors.

The invention also provides a non-naturally occurring or engineered composition which is a composition having the characteristics as discussed herein or defined in any of the herein described methods.

The invention also provides a vector system comprising one or more vectors, the one or more vectors comprising one or more polynucleotide molecules encoding components of a non-naturally occurring or engineered composition which is a composition having the characteristics as discussed herein or defined in any of the herein described methods.

The invention also provides a delivery system comprising one or more vectors or one or more polynucleotide molecules, the one or more vectors or polynucleotide molecules comprising one or more polynucleotide molecules encoding components of a non-naturally occurring or engineered composition which is a composition having the characteristics as discussed herein or defined in any of the herein described methods.

The invention also provides a non-naturally occurring or engineered composition, or one or more polynucleotides encoding components of said composition, or vector or delivery systems comprising one or more polynucleotides encoding components of said composition for use in a therapeutic method of treatment. The therapeutic method of treatment may comprise gene or genome editing, or gene therapy.

The invention also encompasses computational methods and algorithms to predict new Class 2 CRISPR-Cas systems and identify the components therein.

The invention also provides for methods and compositions wherein one or more amino acid residues of the effector protein may be modified, e.g, an engineered or non-naturally-occurring effector protein or Cpf1. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of one or other DNA strand at the target locus of interest. The effector protein may not direct cleavage of either DNA strand at the target locus of interest. In a preferred embodiment, the one or more mutations may comprise two mutations. In a preferred embodiment the one or more amino acid residues are modified in a Cpf1 effector protein, e.g, an engineered or non-naturally-occurring effector protein or Cpf1. In a preferred embodiment the Cpf1 effector protein is an AsCpf1, LbCpf1 or a FnCpf1 effector protein. In a preferred embodiment, the one or more modified or mutated amino acid residues are D917A, E1006A or D1255A with reference to the amino acid position numbering of the FnCpf1 effector protein. In further preferred embodiments, the one or more mutated amino acid residues are D908A, E993A, D1263A with reference to the amino acid positions in AsCpf1 or LbD832A, E925A, D947A or D1180A with reference to the amino acid positions in LbCpf1.

The invention also provides for the one or more mutations or the two or more mutations to be in a catalytically active domain of the effector protein comprising a RuvC domain. In some embodiments of the invention the RuvC domain may comprise a RuvCI, RuvCII or RuvCIII domain, or a catalytically active domain which is homologous to a RuvCI, RuvCII or RuvCIII domain etc or to any relevant domain as described in any of the herein described methods. The effector protein may comprise one or more heterologous functional domains. The one or more heterologous functional domains may comprise one or more nuclear localization signal (NLS) domains. The one or more heterologous functional domains may comprise at least two or more NLS domains. The one or more NLS domain(s) may be positioned at or near or in proximity to a terminus of the effector protein (e.g., Cpf1) and if two or more NLSs, each of the two may be positioned at or near or in proximity to a terminus of the effector protein (e.g., Cpf1) The one or more heterologous functional domains may comprise one or more transcriptional activation domains. In a preferred embodiment the transcriptional activation domain may comprise VP64. The one or more heterologous functional domains may comprise one or more transcriptional repression domains. In a preferred embodiment the transcriptional repression domain comprises a KRAB domain or a SID domain (e.g. SID4X). The one or more heterologous functional domains may comprise one or more nuclease domains. In a preferred embodiment a nuclease domain comprises Fok1.

The invention also provides for the one or more heterologous functional domains to have one or more of the following activities: methylase activity, demethylase activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity and nucleic acid binding activity. At least one or more heterologous functional domains may be at or near the amino-terminus of the effector protein and/or wherein at least one or more heterologous functional domains is at or near the carboxy-terminus of the effector protein. The one or more heterologous functional domains may be fused to the effector protein. The one or more heterologous functional domains may be tethered to the effector protein. The one or more heterologous functional domains may be linked to the effector protein by a linker moiety.

The invention also provides for the effector protein (e.g., a Cpf1) comprising an effector protein (e.g., a Cpf1) from an organism from a genus comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* or *Acidaminococcus*.

The invention also provides for the effector protein (e.g., a Cpf1) comprising an effector protein (e.g., a Cpf1) from an organism from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes; L. ivanovii; C. botulinum, C. difficile, C. tetani, C. sordellii*.

The effector protein may comprise a chimeric effector protein comprising a first fragment from a first effector protein (e.g., a Cpf1) ortholog and a second fragment from a second effector (e.g., a Cpf1) protein ortholog, and wherein the first and second effector protein orthologs are different. At least one of the first and second effector protein (e.g., a Cpf1) orthologs may comprise an effector protein (e.g., a Cpf1) from an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* or *Acidaminococcus*; e.g., a chimeric effector protein comprising a first fragment and a second fragment wherein each of the first and second fragments is selected from a Cpf1 of an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* or *Acidaminococcus* wherein the first and second fragments are not from the same bacteria; for instance a chimeric effector protein comprising a first fragment and a second fragment wherein each of the first and second fragments is selected from a Cpf1 of *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis, Lachnospiraceae bacterium* MC2017 1, *Butyrivibrio proteoclasticus, Peregrinibacteria bacterium* GW2011_GWA2_33 10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens* and *Porphyromonas macacae*, wherein the first and second fragments are not from the same bacteria.

In preferred embodiments of the invention the effector protein is derived from a Cpf1 locus (herein such effector proteins are also referred to as "Cpf1p"), e.g., a Cpf1 protein (and such effector protein or Cpf1 protein or protein derived from a Cpf1 locus is also called "CRISPR enzyme"). Cpf1 loci include but are not limited to the Cpf1 loci of bacterial species listed in FIG. 27. In a more preferred embodiment, the Cpf1p is derived from a bacterial species selected from *Francisella tularensis* 1, *Prevotella albensis, Lachnospiraceae bacterium* MC2017 1, *Butyrivibrio proteoclasticus, Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens* and *Porphyromonas macacae*. In certain embodiments, the Cpf1p is derived from a bacterial species selected from *Acidaminococcus* sp. BV3L6, *Lachnospiraceae bacterium* MA2020. In certain embodiments, the effector protein is derived from a subspecies of *Francisella tularensis* 1, including but not limited to *Francisella tularensis* subsp. *Novicida*.

In further embodiments of the invention a protospacer adjacent motif (PAM) or PAM-like motif directs binding of the effector protein complex to the target locus of interest. In a preferred embodiment of the invention, the PAM is 5' TTN, where N is A/C/G or T and the effector protein is FnCpf1p. In another preferred embodiment of the invention, the PAM is 5' TTTV, where V is A/C or G and the effector protein is AsCpf1, LbCpf1 or PaCpf1p. In certain embodiments, the PAM is 5' TTN, where N is A/C/G or T, the effector protein is FnCpf1p, and the PAM is located upstream of the 5' end of the protospacer. In certain embodiments of the invention, the PAM is 5' CTA, where the effector protein is FnCpf1p, and the PAM is located upstream of the 5' end of the protospacer or the target locus. In preferred embodiments, the invention provides for an expanded targeting range for RNA guided genome editing nucleases wherein the T-rich PAMs of the Cpf1 family allow for targeting and editing of AT-rich genomes.

In certain embodiments, the CRISPR enzyme is engineered and can comprise one or more mutations that reduce or eliminate a nuclease activity. The amino acid positions in the FnCpf1p RuvC domain include but are not limited to D917A, E1006A, E1028A, D1227A, D1255A, N1257A, D917A, E1006A, E1028A, D1227A, D1255A and N1257A. Applicants have also identified a putative second nuclease domain which is most similar to PD-(D/E)XK nuclease superfamily and HincII endonuclease like. The point mutations to be generated in this putative nuclease domain to substantially reduce nuclease activity include but are not limited to N580A, N584A, T587A, W609A, D610A, K613A, E614A, D616A, K624A, D625A, K627A and Y629A. In a preferred embodiment, the mutation in the FnCpf1p RuvC domain is D917A or E1006A, wherein the D917A or E1006A mutation completely inactivates the DNA cleavage activity of the FnCpf1 effector protein. In another embodiment, the mutation in the FnCpf1p RuvC domain is D1255A, wherein the mutated FnCpf1 effector protein has significantly reduced nucleolytic activity.

The amino acid positions in the AsCpf1p RuvC domain include but are not limited to 908, 993, and 1263. In a preferred embodiment, the mutation in the AsCpf1p RuvC domain is D908A, E993A, and D1263A, wherein the D908A, E993A, and D1263A mutations completely inactivates the DNA cleavage activity of the AsCpf1 effector protein. The amino acid positions in the LbCpf1p RuvC domain include but are not limited to 832, 947 or 1180. In a preferred embodiment, the mutation in the LbCpf1p RuvC domain is LbD832A, E925A, D947A or D1180A, wherein the LbD832A E925A, D947A or D 1180A mutations completely inactivates the DNA cleavage activity of the LbCpf1 effector protein.

Mutations can also be made at neighboring residues, e.g., at amino acids near those indicated above that participate in the nuclease activity. In some embodiments, only the RuvC domain is inactivated, and in other embodiments, another putative nuclease domain is inactivated, wherein the effector protein complex functions as a nickase and cleaves only one DNA strand. In a preferred embodiment, the other putative nuclease domain is a HincII-like endonuclease domain. In some embodiments, two FnCpf1 variants (each a different nickase) are used to increase specificity, two nickase variants are used to cleave DNA at a target (where both nickases cleave a DNA strand, while minimizing or eliminating off-target modifications where only one DNA strand is cleaved and subsequently repaired). In preferred embodiments the Cpf1 effector protein cleaves sequences associated with or at a target locus of interest as a homodimer comprising two Cpf1 effector protein molecules. In a preferred embodiment the homodimer may comprise two Cpf1 effector protein molecules comprising a different mutation in their respective RuvC domains.

The invention contemplates methods of using two or more nickases, in particular a dual or double nickase approach. In some aspects and embodiments, a single type FnCpf1 nickase may be delivered, for example a modified FnCpf1 or a modified FnCpf1 nickase as described herein. This results in the target DNA being bound by two FnCpf1 nickases. In addition, it is also envisaged that different orthologs may be used, e.g, an FnCpf1 nickase on one strand (e.g., the coding strand) of the DNA and an ortholog on the non-coding or opposite DNA strand. The ortholog can be, but is not limited to, a Cas9 nickase such as a SaCas9 nickase or a SpCas9 nickase. It may be advantageous to use two different orthologs that require different PAMs and may also have different guide requirements, thus allowing a greater deal of control for the user. In certain embodiments, DNA cleavage will involve at least four types of nickases, wherein each type is guided to a different sequence of target DNA, wherein each pair introduces a first nick into one DNA strand and the second introduces a nick into the second DNA strand. In such methods, at least two pairs of single stranded breaks are introduced into the target DNA wherein upon introduction of first and second pairs of single-strand breaks, target sequences between the first and second pairs of single-strand breaks are excised. In certain embodiments, one or both of the orthologs is controllable, i.e. inducible.

In certain embodiments of the invention, the guide RNA or mature crRNA comprises, consists essentially of, or consists of a direct repeat sequence and a guide sequence or spacer sequence. In certain embodiments, the guide RNA or mature crRNA comprises, consists essentially of, or consists of a direct repeat sequence linked to a guide sequence or spacer sequence. In certain embodiments the guide RNA or mature crRNA comprises 19 nts of partial direct repeat followed by 20-30 nt of guide sequence or spacer sequence, advantageously about 20 nt, 23-25 nt or 24 nt. In certain embodiments, the effector protein is a FnCpf1 effector protein and requires at least 16 nt of guide sequence to achieve detectable DNA cleavage and a minimum of 17 nt of guide sequence to achieve efficient DNA cleavage in vitro. In certain embodiments, the direct repeat sequence is located upstream (i.e., 5') from the guide sequence or spacer sequence. In a preferred embodiment the seed sequence (i.e. the sequence essential critical for recognition and/or hybridization to the sequence at the target locus) of the FnCpf1 guide RNA is approximately within the first 5 nt on the 5' end of the guide sequence or spacer sequence.

In preferred embodiments of the invention, the mature crRNA comprises a stem loop or an optimized stem loop structure or an optimized secondary structure. In preferred embodiments the mature crRNA comprises a stem loop or an optimized stem loop structure in the direct repeat sequence, wherein the stem loop or optimized stem loop structure is important for cleavage activity. In certain embodiments, the mature crRNA preferably comprises a single stem loop. In certain embodiments, the direct repeat sequence preferably comprises a single stem loop. In certain embodiments, the cleavage activity of the effector protein complex is modified by introducing mutations that affect the stem loop RNA duplex structure. In preferred embodiments, mutations which maintain the RNA duplex of the stem loop may be introduced, whereby the cleavage activity of the effector protein complex is maintained. In other preferred embodiments, mutations which disrupt the RNA duplex structure of the stem loop may be introduced, whereby the cleavage activity of the effector protein complex is completely abolished.

The invention also provides for the nucleotide sequence encoding the effector protein being codon optimized for expression in a eukaryote or eukaryotic cell in any of the herein described methods or compositions. In an embodiment of the invention, the codon optimized effector protein is FnCpf1p and is codon optimized for operability in a eukaryotic cell or organism, e.g., such cell or organism as elsewhere herein mentioned, for instance, without limitation, a yeast cell, or a mammalian cell or organism, including a mouse cell, a rat cell, and a human cell or non-human eukaryote organism, e.g., plant.

In certain embodiments of the invention, at least one nuclear localization signal (NLS) is attached to the nucleic acid sequences encoding the Cpf1 effector proteins. In preferred embodiments at least one or more C-terminal or N-terminal NLSs are attached (and hence nucleic acid molecule(s) coding for the Cpf1 effector protein can include coding for NLS(s) so that the expressed product has the NLS(s) attached or connected). In a preferred embodiment a C-terminal NLS is attached for optimal expression and nuclear targeting in eukaryotic cells, preferably human cells. In a preferred embodiment, the codon optimized effector protein is FnCpf1p and the spacer length of the guide RNA is from 15 to 35 nt. In certain embodiments, the spacer length of the guide RNA is at least 16 nucleotides, such as at least 17 nucleotides. In certain embodiments, the spacer length is from 15 to 17 nt, from 17 to 20 nt, from 20 to 24 nt, eg. 20, 21, 22, 23, or 24 nt, from 23 to 25 nt, e.g., 23, 24, or 25 nt, from 24 to 27 nt, from 27-30 nt, from 30-35 nt, or 35 nt or longer. In certain embodiments of the invention, the codon optimized effector protein is FnCpf1p and the direct repeat length of the guide RNA is at least 16 nucleotides. In certain embodiments, the codon optimized effector protein is FnCpf1p and the direct repeat length of the guide RNA is from 16 to 20 nt, e.g., 16, 17, 18, 19, or 20 nucleotides. In certain preferred embodiments, the direct repeat length of the guide RNA is 19 nucleotides.

The invention also encompasses methods for delivering multiple nucleic acid components, wherein each nucleic acid component is specific for a different target locus of interest thereby modifying multiple target loci of interest. The nucleic acid component of the complex may comprise one or more protein-binding RNA aptamers. The one or more aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

The invention also encompasses the cells, components and/or systems of the present invention having trace amounts of cations present in the cells, components and/or systems. Advantageously, the cation is magnesium, such as Mg2+. The cation may be present in a trace amount. A preferred range may be about 1 mM to about 15 mM for the cation, which is advantageously Mg2+. A preferred concentration may be about 1 mM for human based cells, components and/or systems and about 10 mM to about 15 mM for bacteria based cells, components and/or systems. See, e.g., Gasiunas et al., PNAS, published online Sep. 4, 2012, worldwideweb.pnas.org/cgi/doi/10.1073/pnas.1208507109.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law.

These and other embodiments are disclosed or are obvious from and encompassed by, the following Detailed Description.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIGS. 4A-4I show the sequence of humanized PaCpf1, with the nucleotide sequence as SEQ ID NO: 375 and the protein sequence as SEQ ID NO: 376.

FIG. 22 is a gel showing testing of different lengths of spacer against a piece of target DNA containing the target site: 5'-TTAgagaagtcatttaataaggccactgttaaaa-3' (SEQ ID NO: 119). The results show that crRNAs 1-7 mediated successful cleavage of the target DNA in vitro with FnCpf1. crRNAs 8-13 did not facilitate cleavage of the target DNA. SEQ ID NOS 393-431 are disclosed, respectively, in order of appearance.

Plotting the distribution shows little enrichment in the control sample and enrichment in both bioreps. (B-D) depict PAM ratio distributions. (E) All PAMs above a ratio of 4.5 were collected, and the frequency distributions were plotted, revealing a 5' TTTV PAM, where V is A or C or G.

Figure 26:
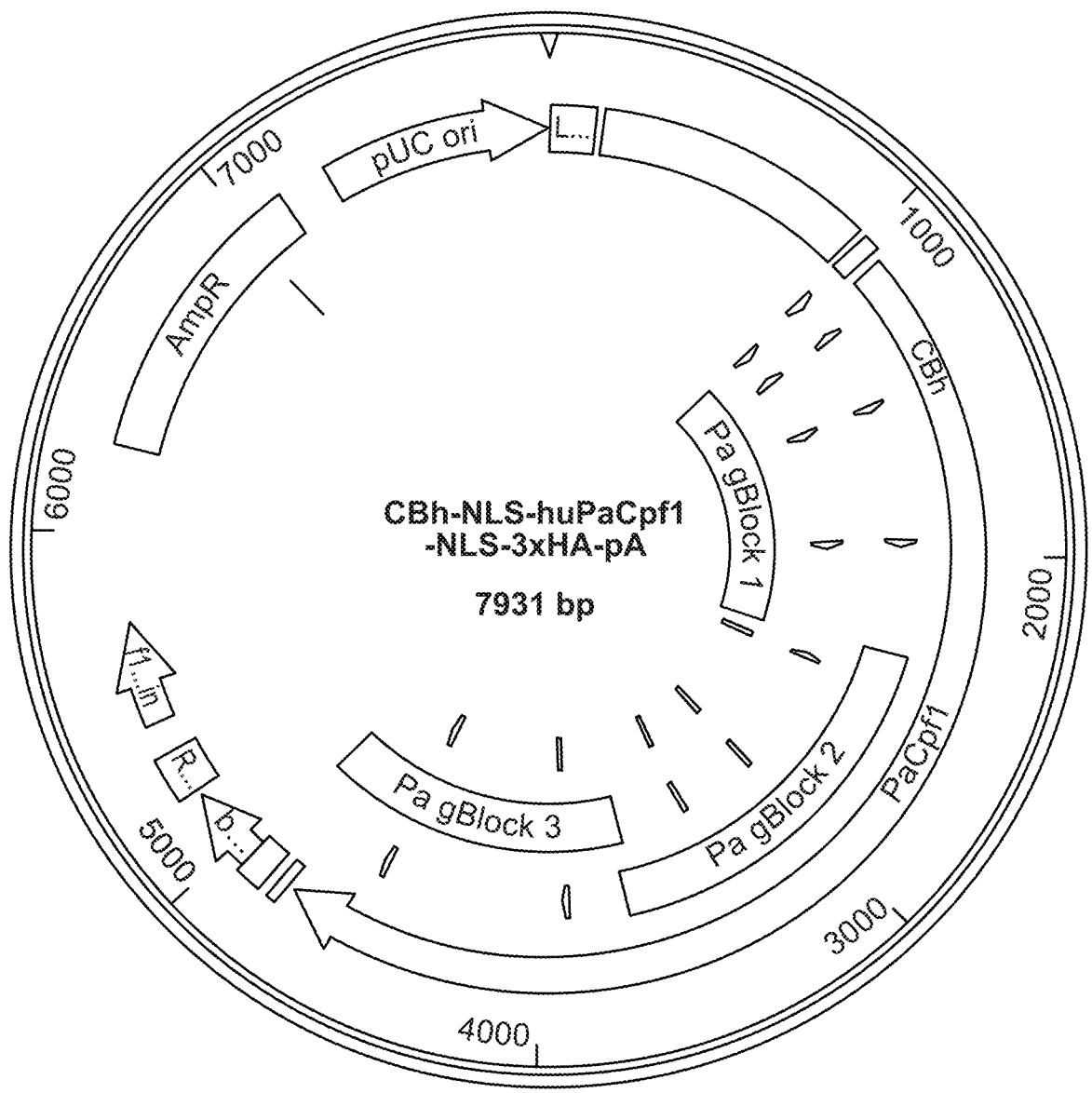

FIG. 26 shows a vector map of the human codon optimized PaCpf1 sequence depicted as CBh-NLS-huPaCpf1-NLS-3xHA-pA.

Figure 27A:
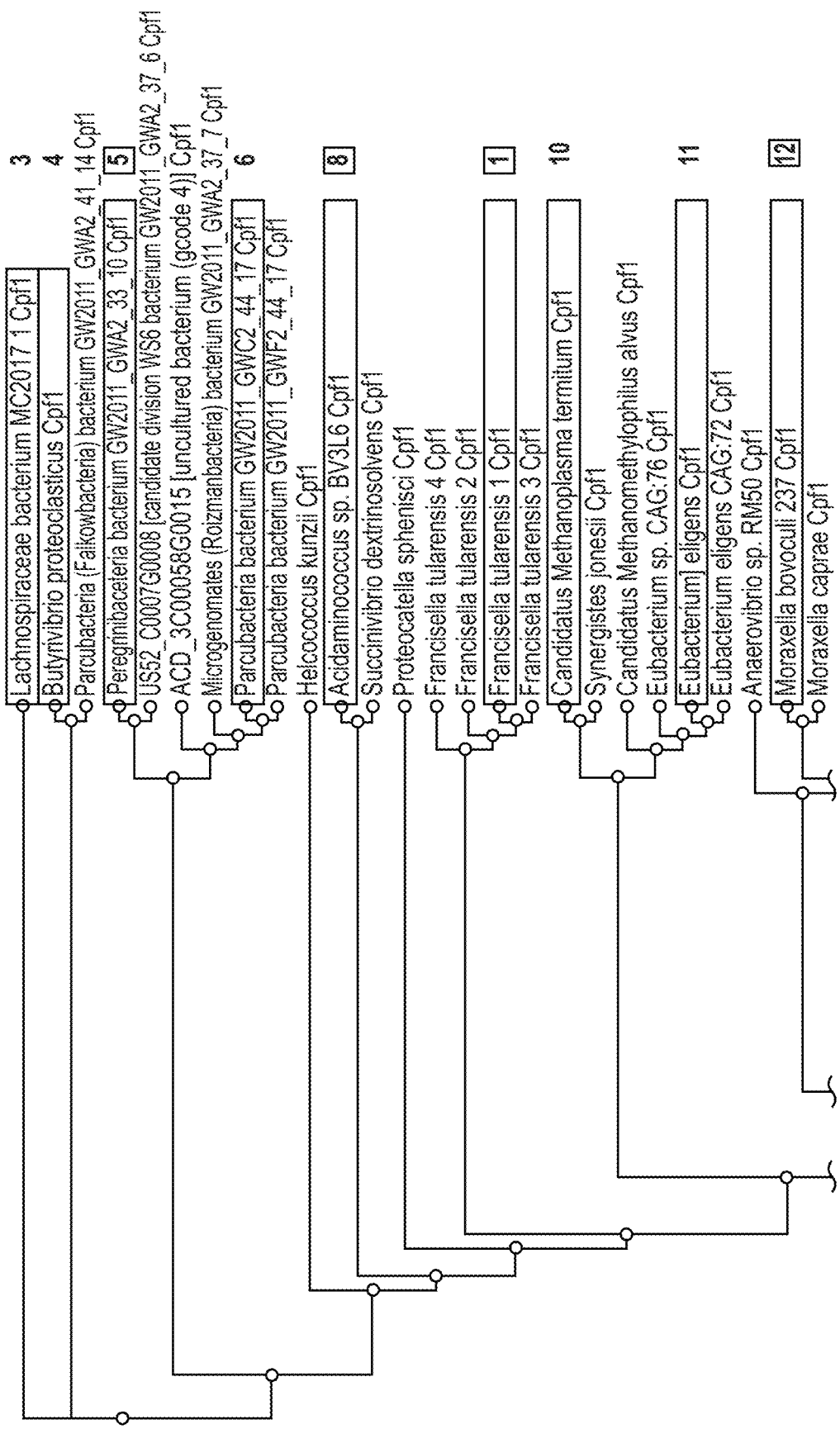
Figure 27B:
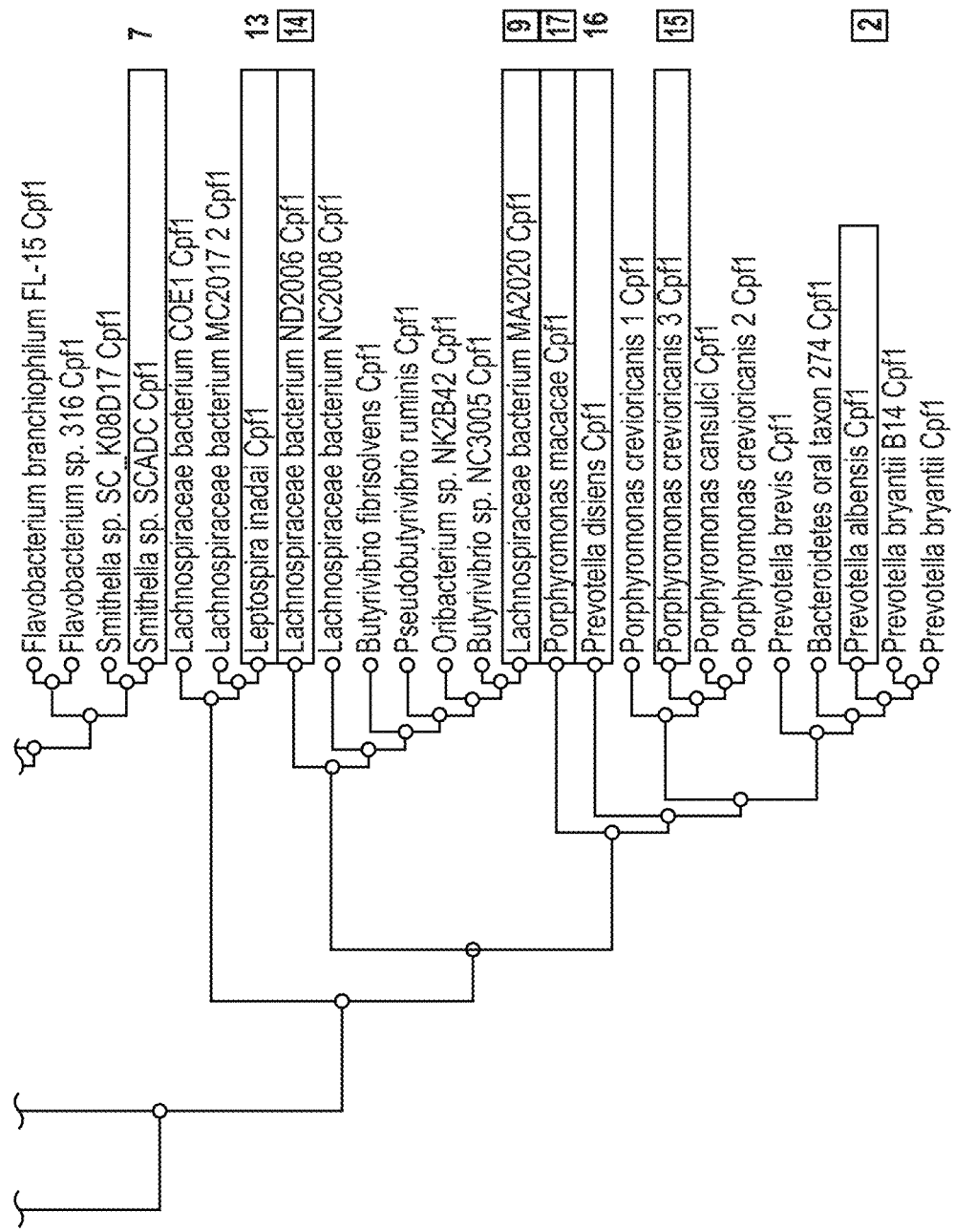

FIGS. 27A-27B show a phylogenetic tree of 51 Cpf1 loci in different bacteria. Highlighted boxes indicate Gene Reference #s: 1-17. Boxed/numbered orthologs were tested for in vitro cleavage activity with predicted mature crRNA; orthologs with boxes around their numbers showed activity in the in vitro assay.

Figure 28A:
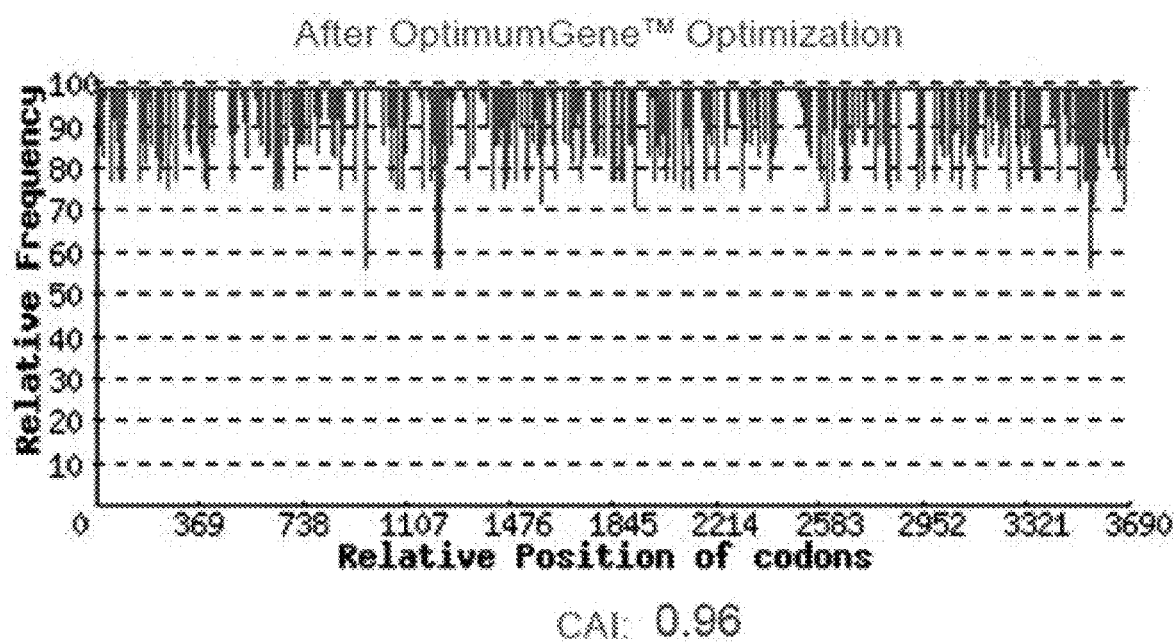
Figure 28B:
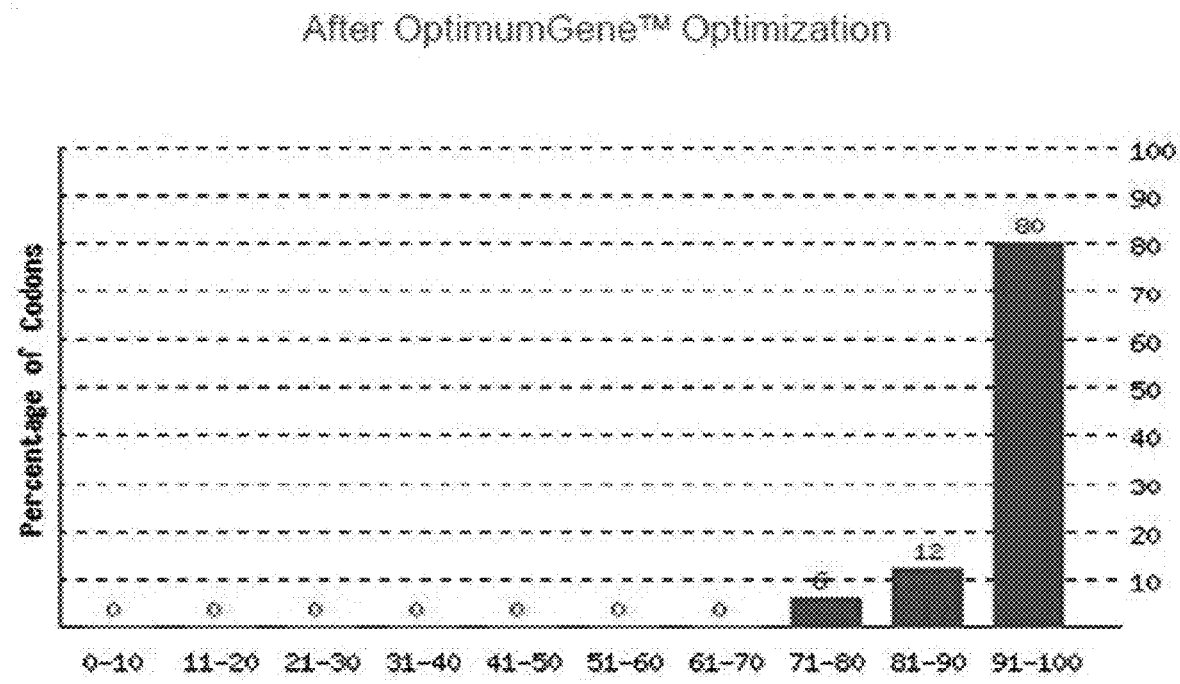
Figure 28C:
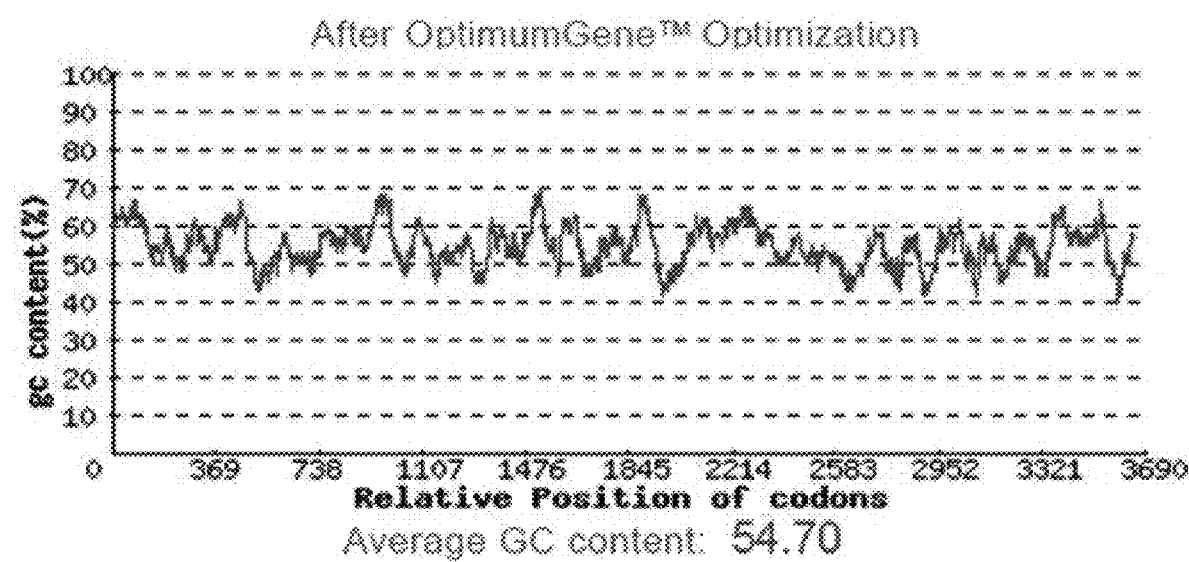

FIGS. 28A-28H show the details of the human codon optimized sequence for *Lachnospiraceae bacterium* MC2017 1 Cpf1 having a gene length of 3849 nts (Ref #3 in FIG. 27). FIG. 28A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 28B: Frequency of Optimal Codons (FOP). The percentage distribution of codons in computed codon quality groups. The value of 100 is set for the codon with the highest usage frequency for a given amino acid in the desired expression organism. FIG. 28C: GC Content Adjustment. The ideal percentage range of GC content is between 30-70%. Peaks of % GC content in a 60 bp window have been removed. FIG. 28D: Restriction Enzymes and CIS-Acting Elements. FIG. 28E: Remove Repeat Sequences. FIG. 28F-G: Optimized Sequence (Optimized Sequence Length: 3849, GC % 54.70) (SEQ ID NO: 433). FIG. 28H: Protein Sequence (SEQ ID NO: 434).

Figure 29A:
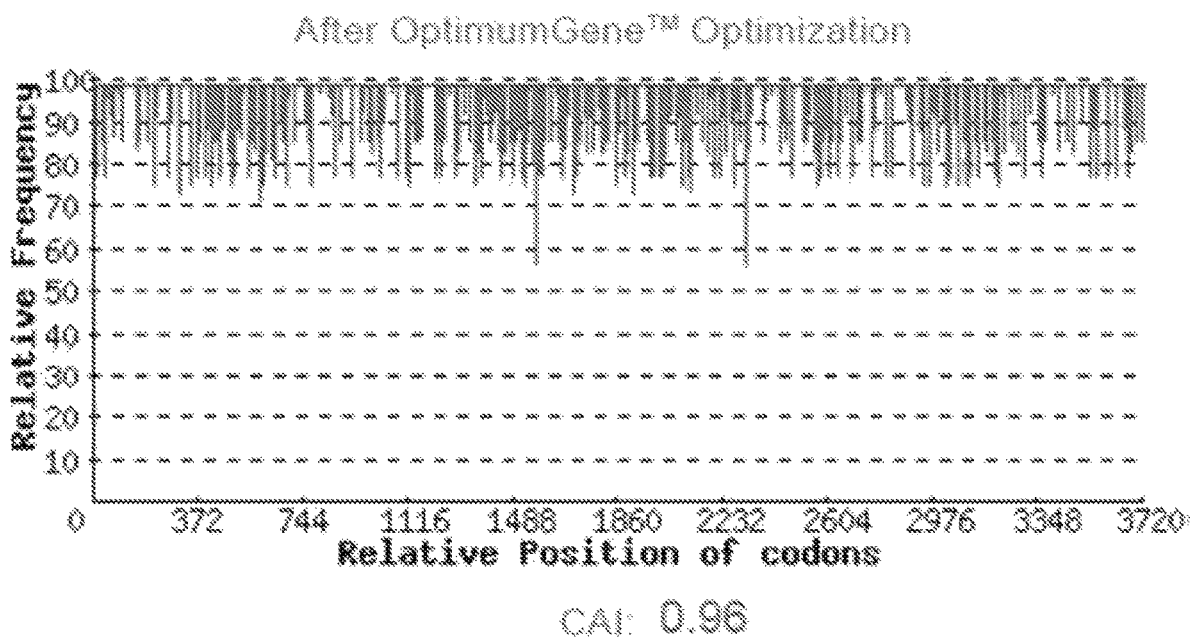
Figure 29B:
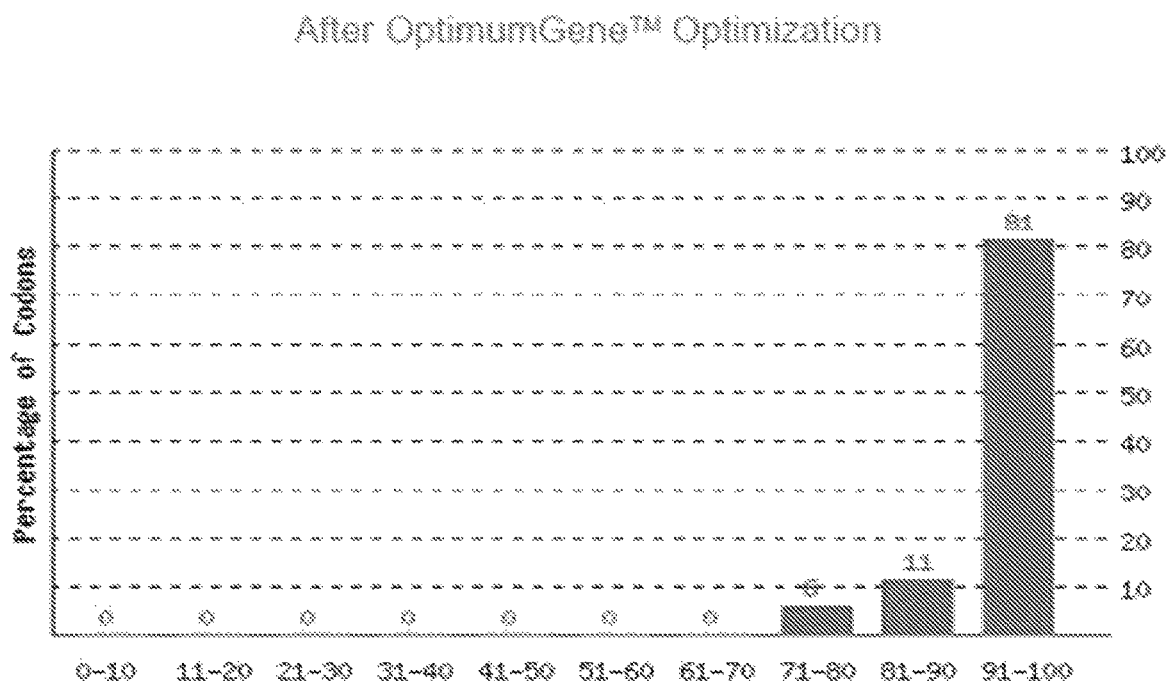
Figure 29C:
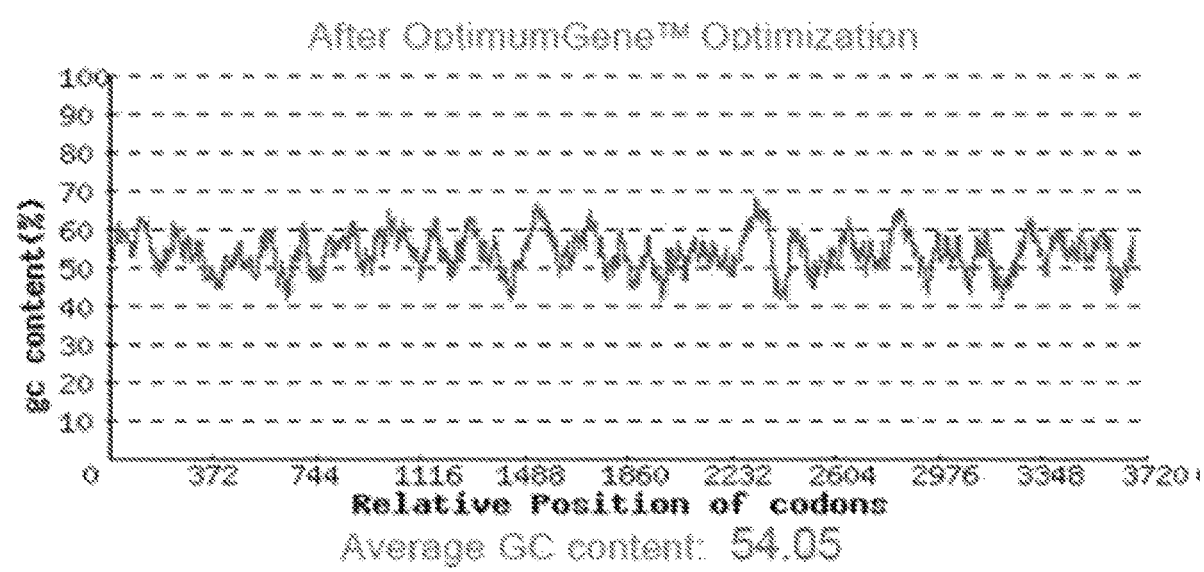
Figure 29F:
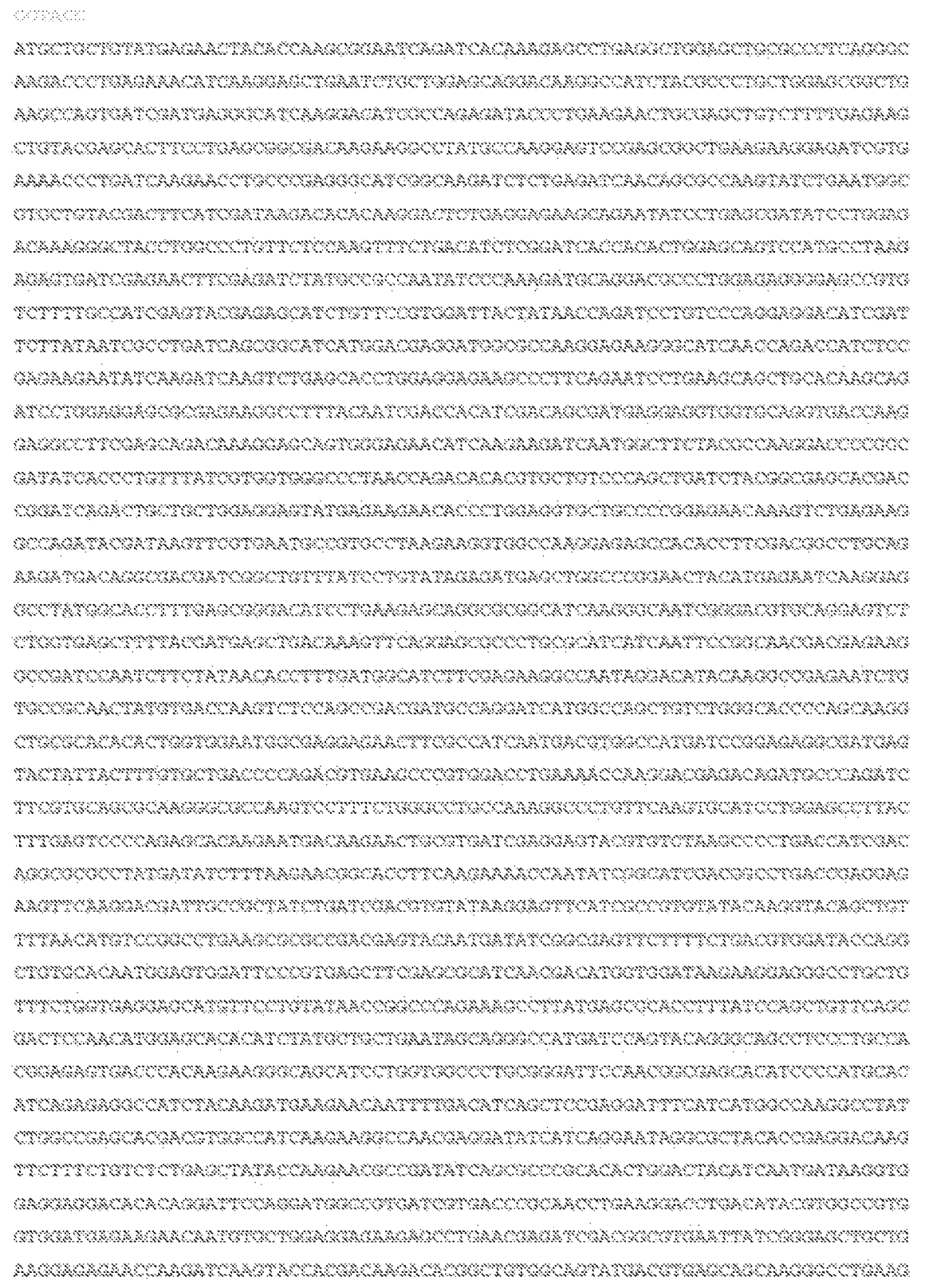

FIGS. 29A-29H show the details of the human codon optimized sequence for *Butyrivibrio proteoclasticus* Cpf1 having a gene length of 3873 nts (Ref #4 in FIG. 27). FIG. 29A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 29B: Frequency of Optimal Codons (FOP). The percentage distribution of codons in computed codon quality groups. The value of 100 is set for the codon with the highest usage frequency for a given amino acid in the desired expression organism. FIG. 29C: GC Content Adjustment. The ideal percentage range of GC content is between 30-70%. Peaks of % GC content in a 60 bp window have been removed. FIG. 29D: Restriction Enzymes and CIS-Acting Elements. FIG. 29E: Remove Repeat Sequences. FIG. 29F-G: Optimized Sequence (Optimized Sequence Length: 3873, GC % 54.05) (SEQ ID NO: 435). FIG. 29H: Protein Sequence (SEQ ID NO: 436).

Figure 30A:
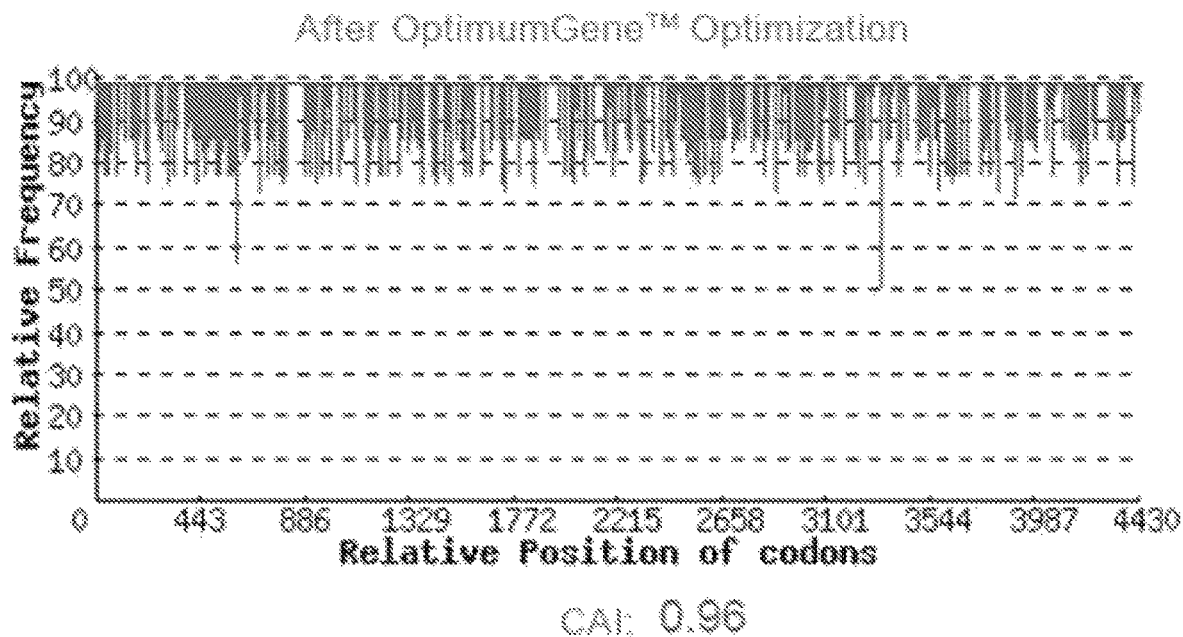
Figure 30B:
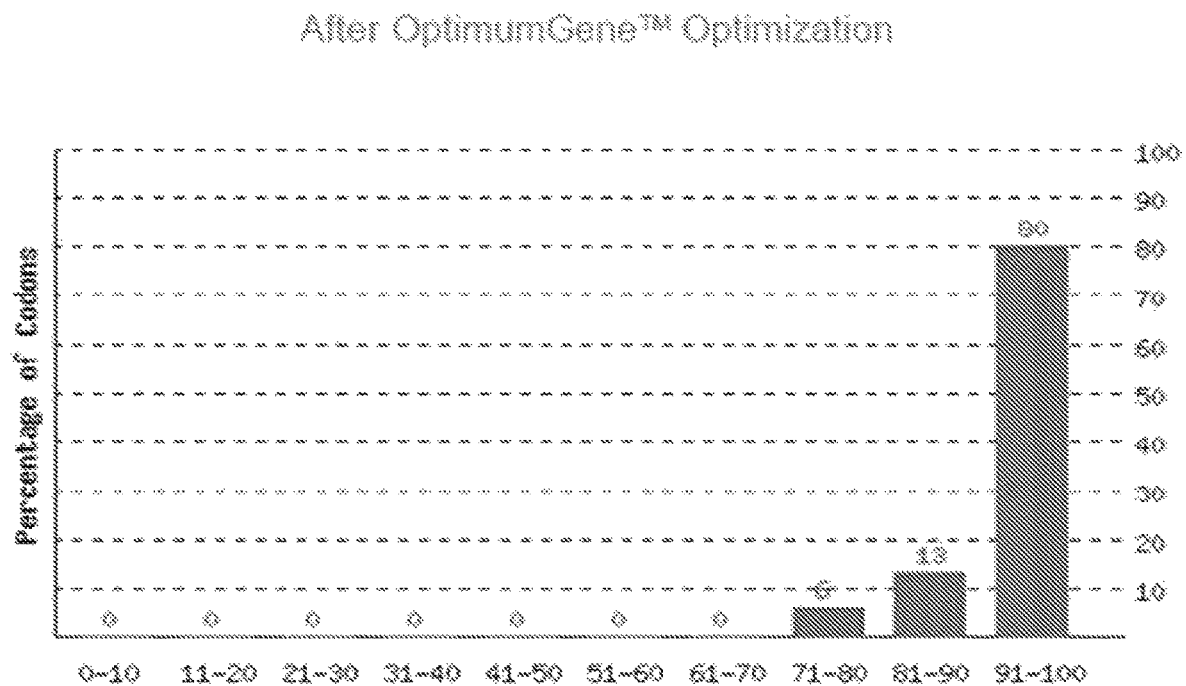
Figure 30C:
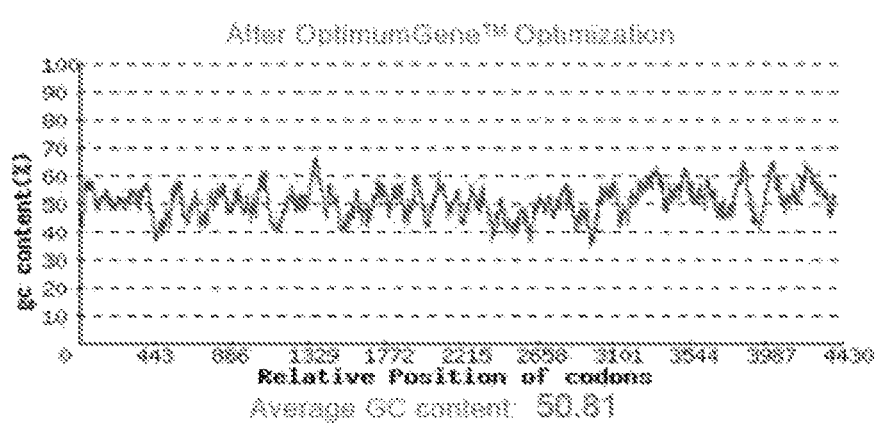

FIGS. 30A-30H show the details of the human codon optimized sequence for *Peregrinibacteria bacterium* GW2011_GWA2_33_10 Cpf1 having a gene length of 4581 nts (Ref #5 in FIG. 27). FIG. 30A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 30B: Frequency of Optimal Codons (FOP). The percentage distribution of codons in computed codon quality groups. The value of 100 is set for the codon with the highest usage frequency for a given amino acid in the desired expression organism. FIG. 30C: GC Content Adjustment. The ideal percentage range of GC content is between 30-70%. Peaks of % GC content in a 60 bp window have been removed. FIG. 30D: Restriction Enzymes and CIS-Acting Elements. FIG. 30E: Remove Repeat Sequences. FIG. 30F-G: Optimized Sequence (Optimized Sequence Length: 4581, GC % 50.81) (SEQ ID NO: 437). FIG. 30H: Protein Sequence (SEQ ID NO: 438).

Figure 31A:
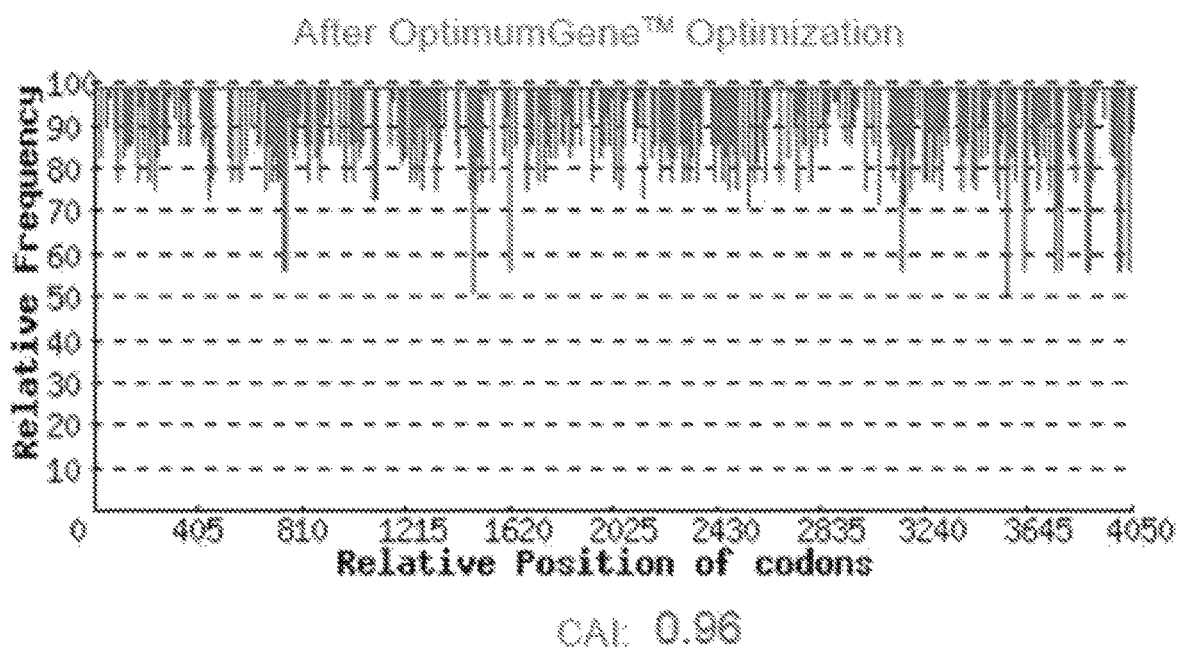
Figure 31B:
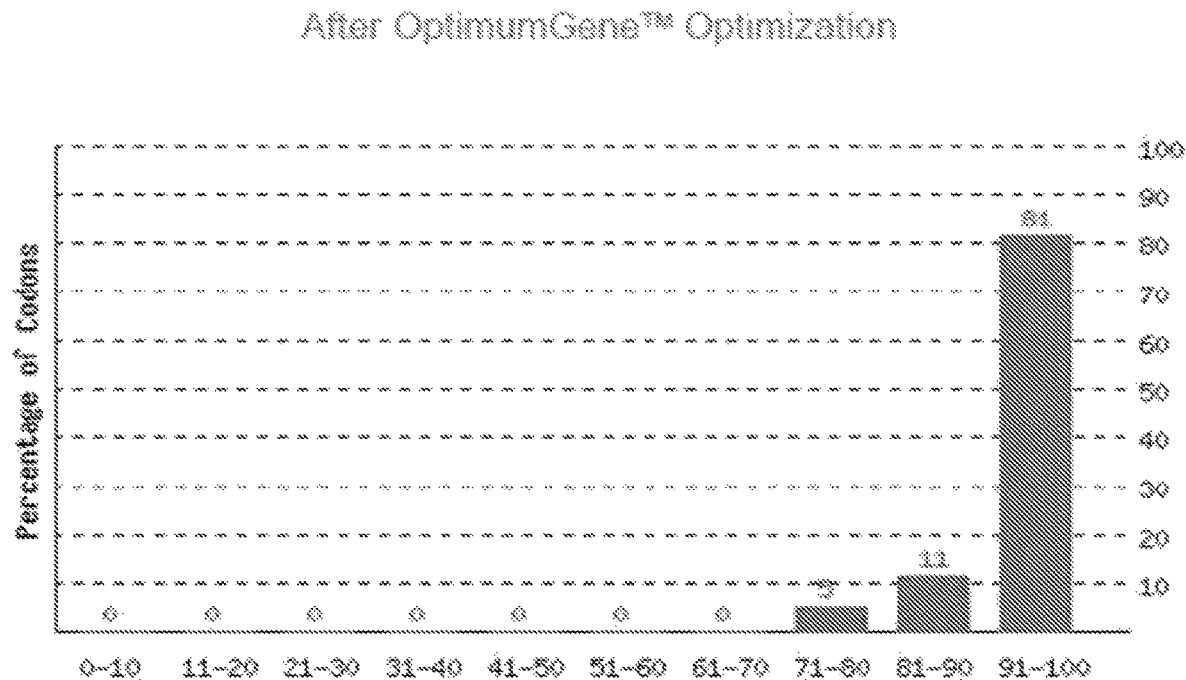
Figure 31C:
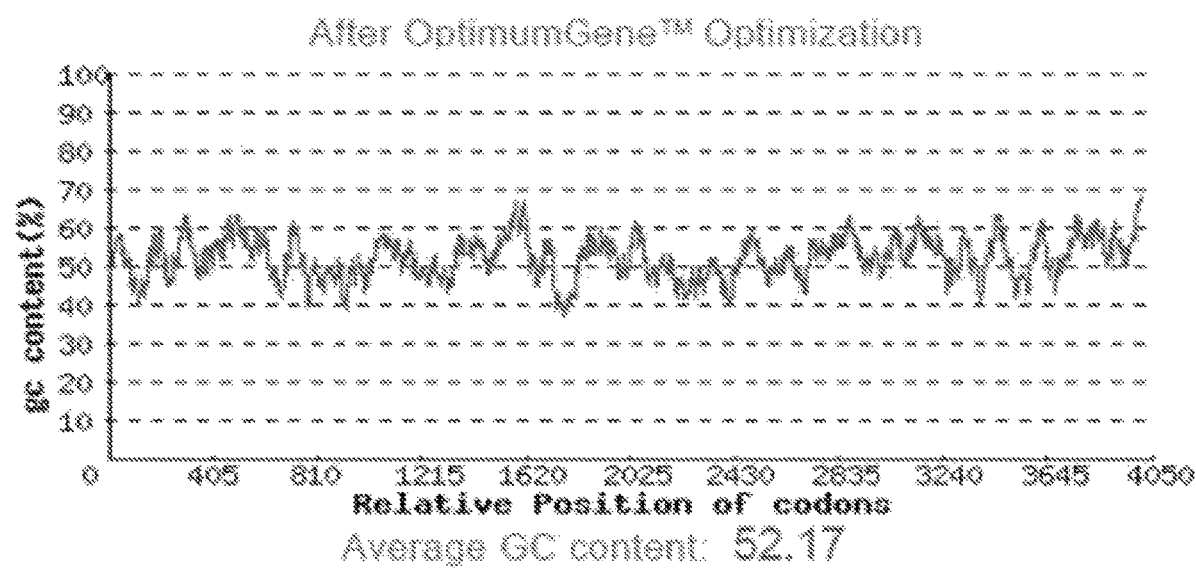
Figure 31F:
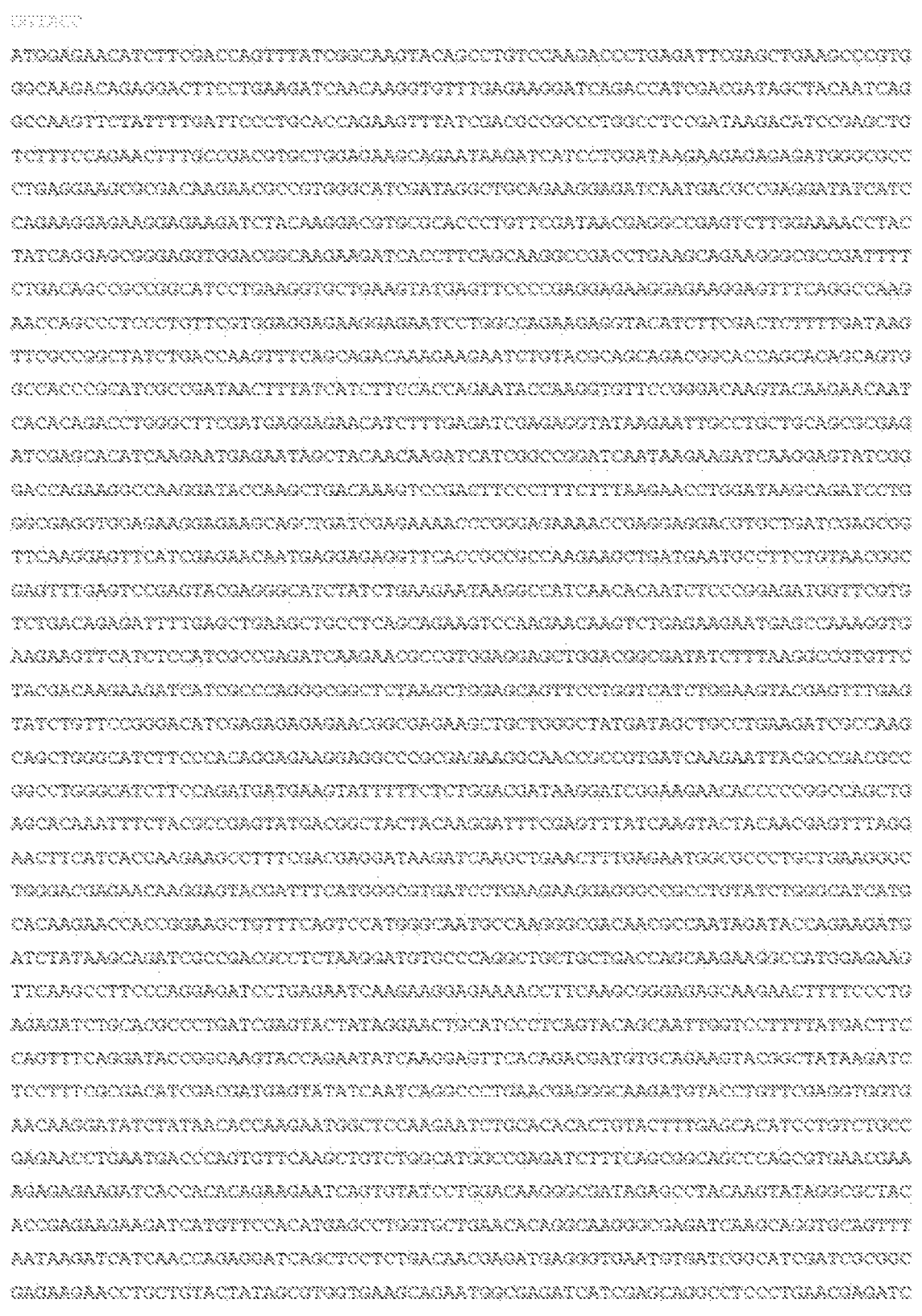

FIGS. 31A-31H show the details of the human codon optimized sequence for *Parcubacteria bacterium* GW2011_GWC2_44_17 Cpf1 having a gene length of 4206 nts (Ref #6 in FIG. 27). FIG. 31A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 31B: Frequency of Optimal Codons (FOP). The percentage distribution of codons in computed codon quality groups. The value of 100 is set for the codon with the highest usage frequency for a given amino acid in the desired expression organism. FIG. 31C: GC Content Adjustment. The ideal percentage range of GC content is between 30-70%. Peaks of % GC content in a 60 bp window have been removed. FIG. 31D: Restriction Enzymes and CIS-Acting Elements. FIG. 31E: Remove Repeat Sequences. FIG. 31F-G: Optimized Sequence (Optimized Sequence Length: 4206, GC % 52.17) (SEQ ID NO: 439). FIG. 31H: Protein Sequence (SEQ ID NO: 440).

Figure 32A:
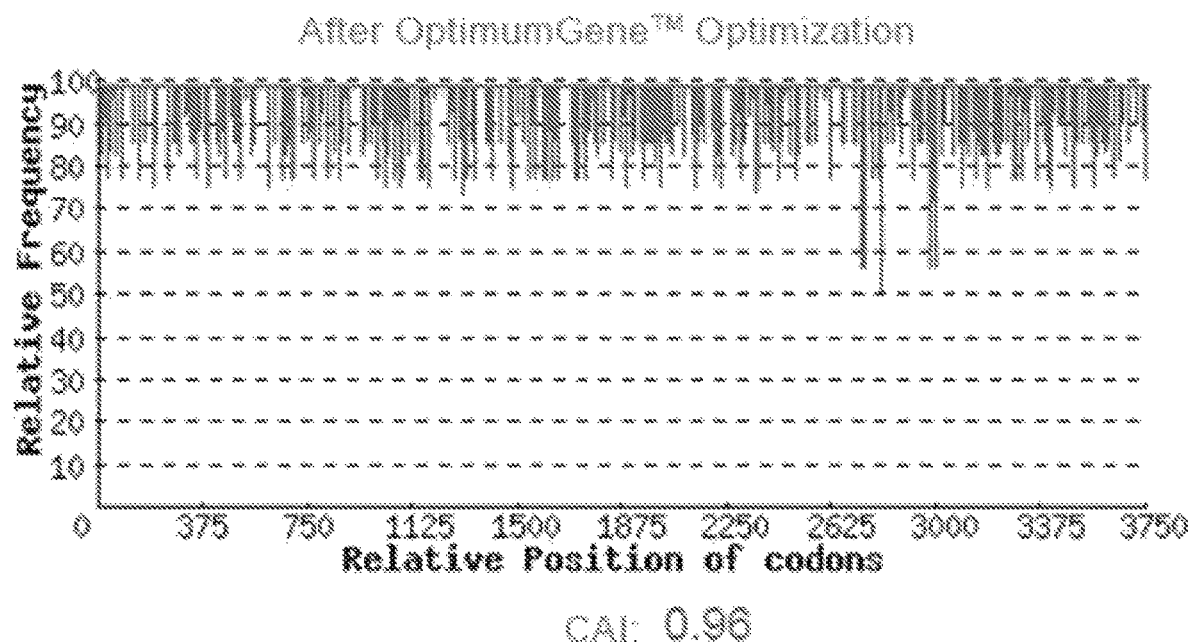
Figure 32B:
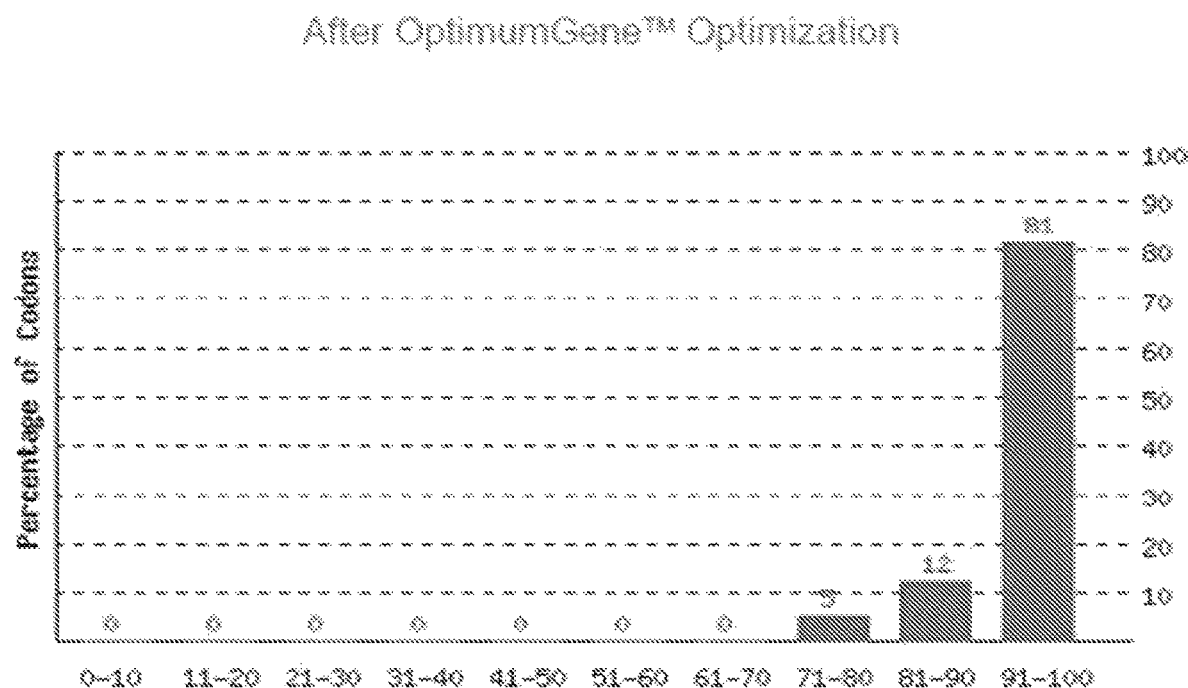
Figure 32C:
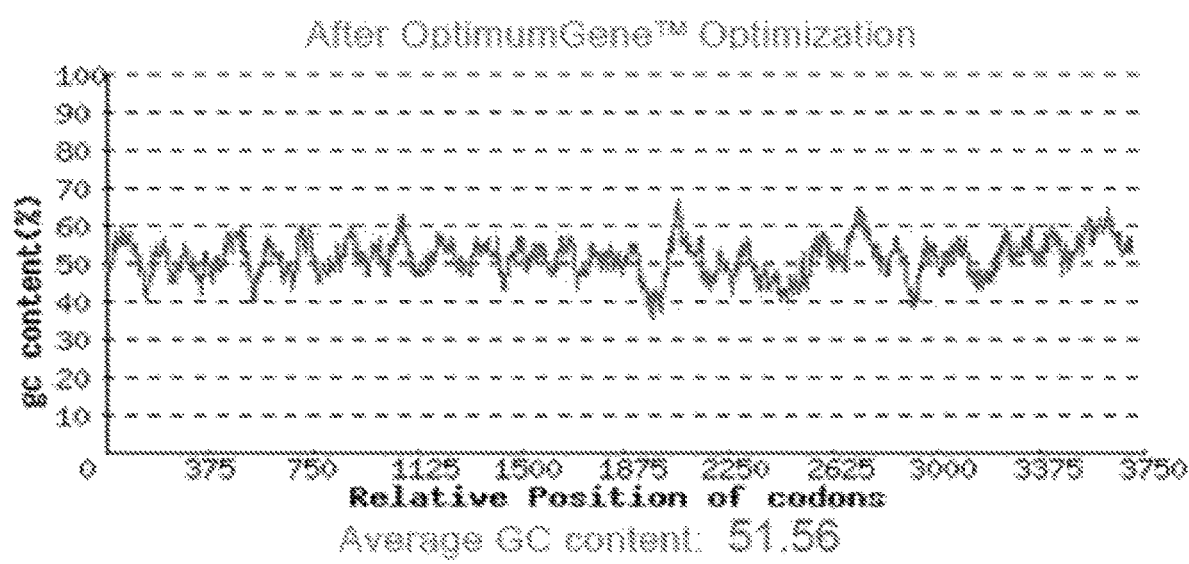
Figure 32F:
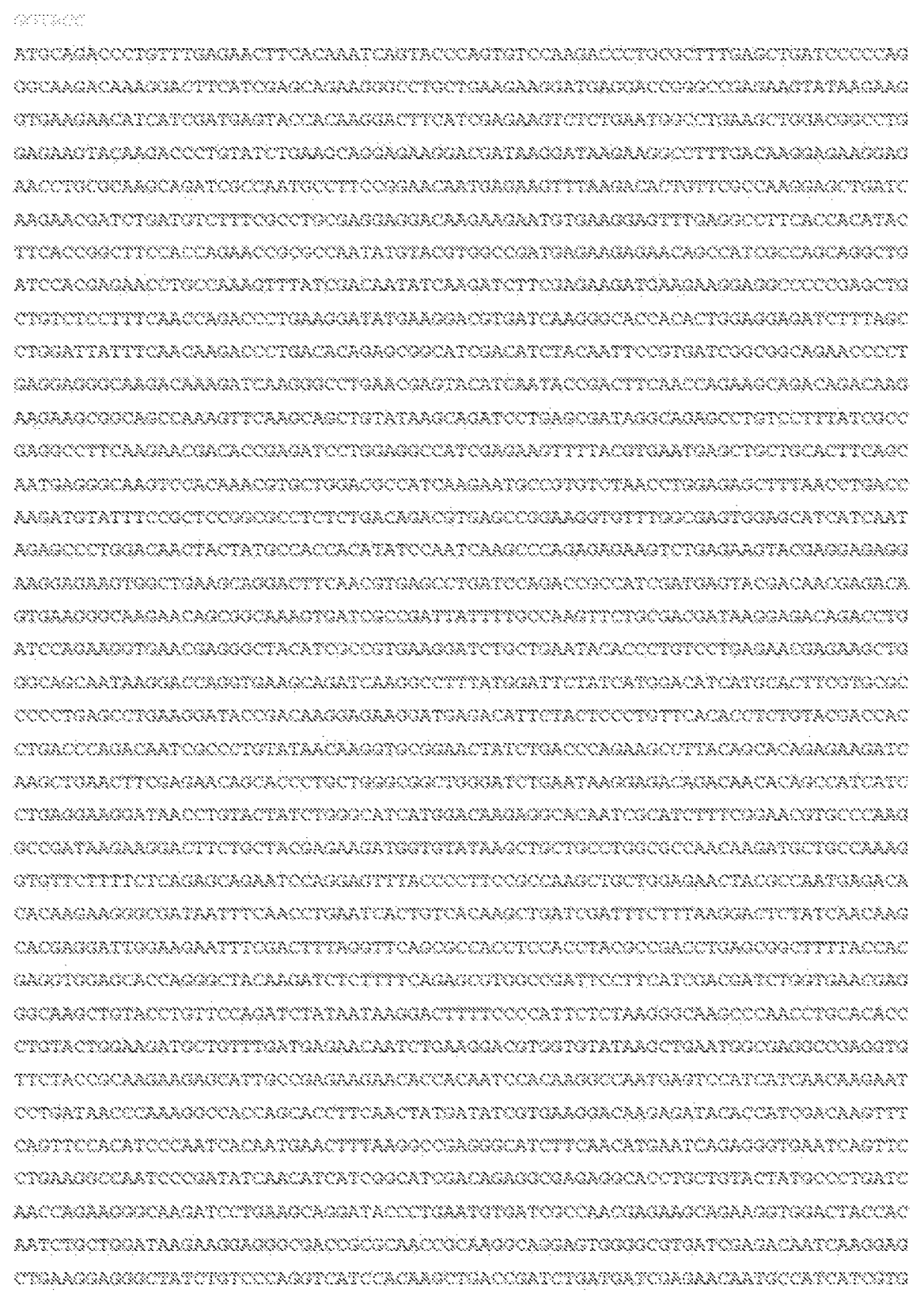

FIGS. 32A-32H show the details of the human codon optimized sequence for *Smithella* sp. SCADC Cpf1 having a gene length of 3900 nts (Ref #7 in FIG. 27). FIG. 32A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 32B: Frequency of Optimal Codons (FOP). The percentage distribution of codons in computed codon quality groups. The value of 100 is set for the codon with the highest usage frequency for a given amino acid in the desired expression organism. FIG. 32C: GC Content Adjustment. The ideal percentage range of GC content is between 30-70%. Peaks of % GC content in a 60 bp window have been removed. FIG. 32D: Restriction Enzymes and CIS-Acting Elements. FIG. 69E: Remove Repeat Sequences. FIG. 32F-G: Optimized Sequence (Optimized Sequence Length: 3900, GC % 51.56) (SEQ ID NO: 441). FIG. 32H: Protein Sequence (SEQ ID NO: 442).

Figure 33A:
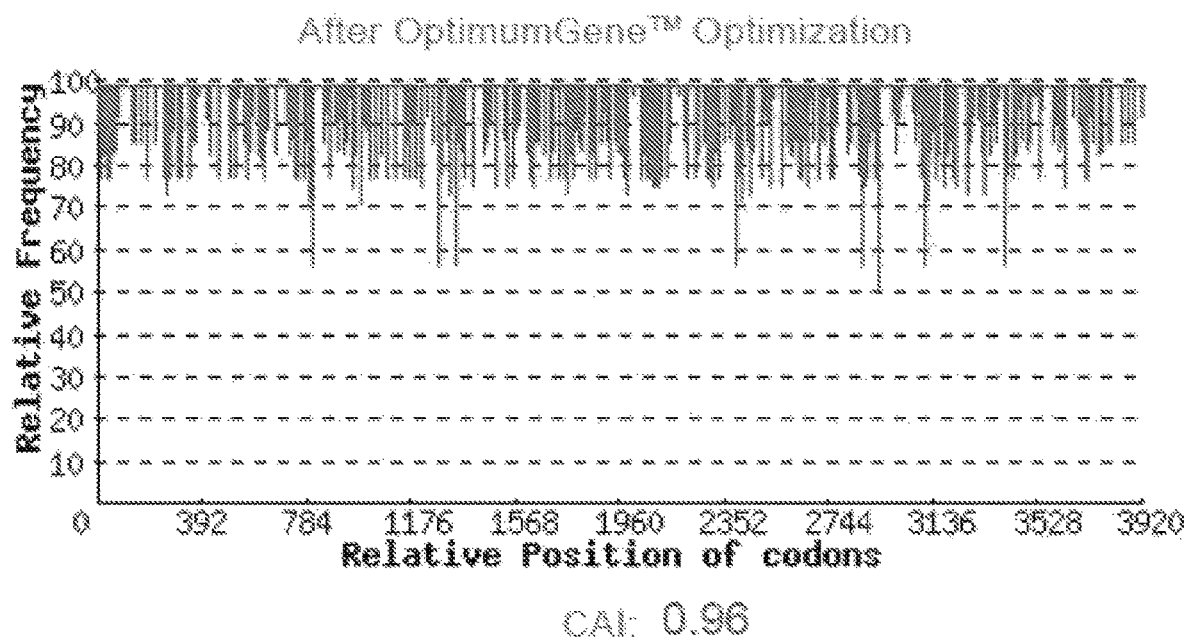
Figure 33B:
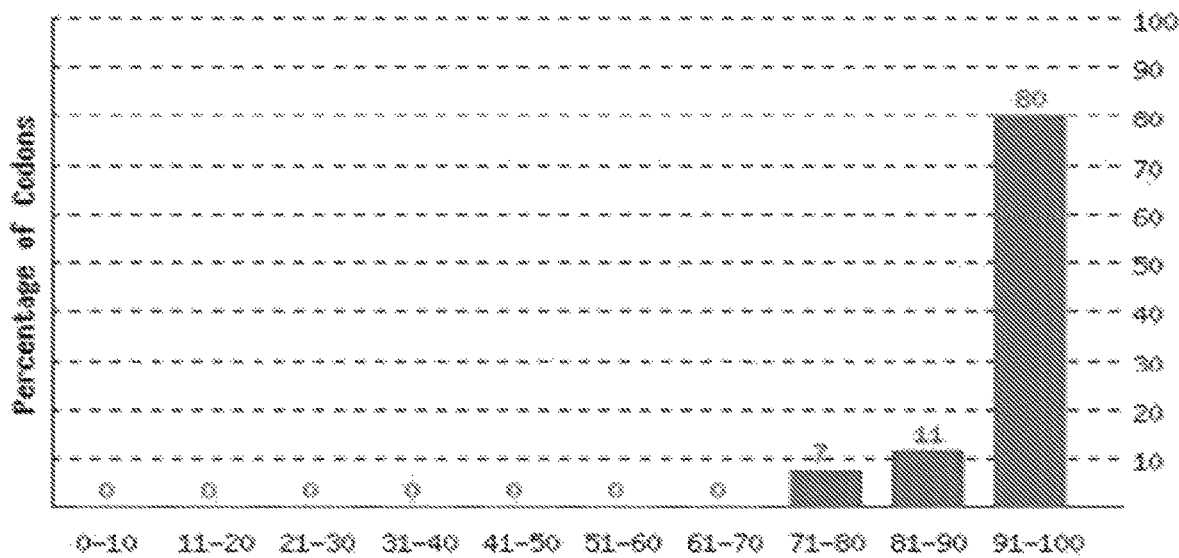
Figure 33C:
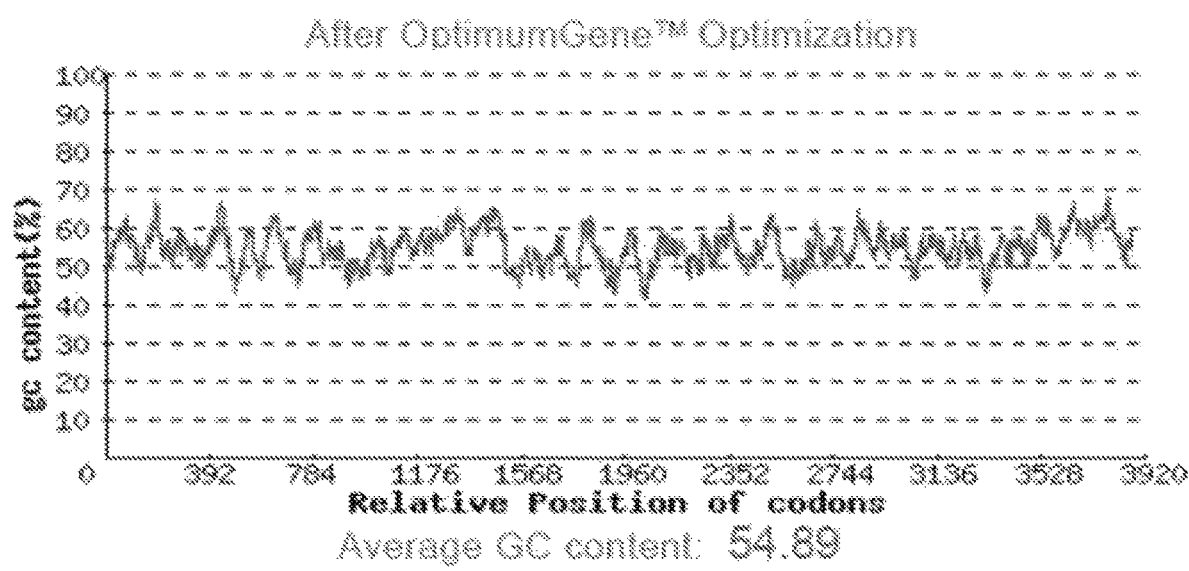
Figure 33F:
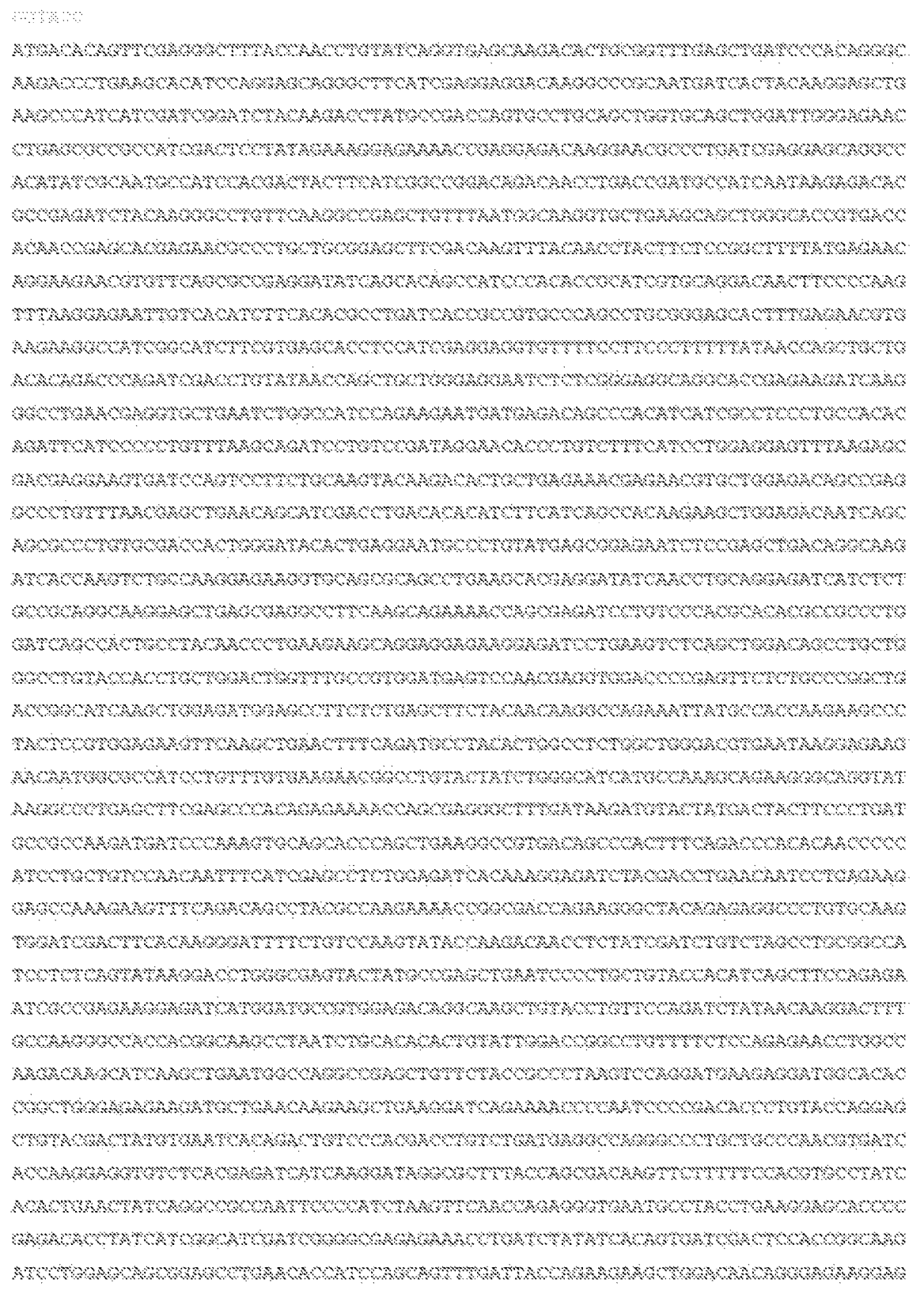

FIGS. 33A-33H show the details of the human codon optimized sequence for *Acidaminococcus* sp. BV3L6 Cpf1 having a gene length of 4071 nts (Ref #8 in FIG. 27). FIG. 33A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 33B: Frequency of Optimal Codons (FOP). The percentage distribution of codons in computed codon quality groups. The value of 100 is set for the codon with the highest usage frequency for a given amino acid in the desired expression organism. FIG. 33C: GC Content Adjustment. The ideal percentage range of GC content is between 30-70%. Peaks of % GC content in a 60 bp window have been removed. FIG. 33D: Restriction Enzymes and CIS-Acting Elements. FIG. 70E: Remove Repeat Sequences. FIG. 33F-G: Optimized Sequence (Optimized Sequence Length: 4071, GC % 54.89) (SEQ ID NO: 443). FIG. 33H: Protein Sequence (SEQ ID NO: 444).

Figure 34A:
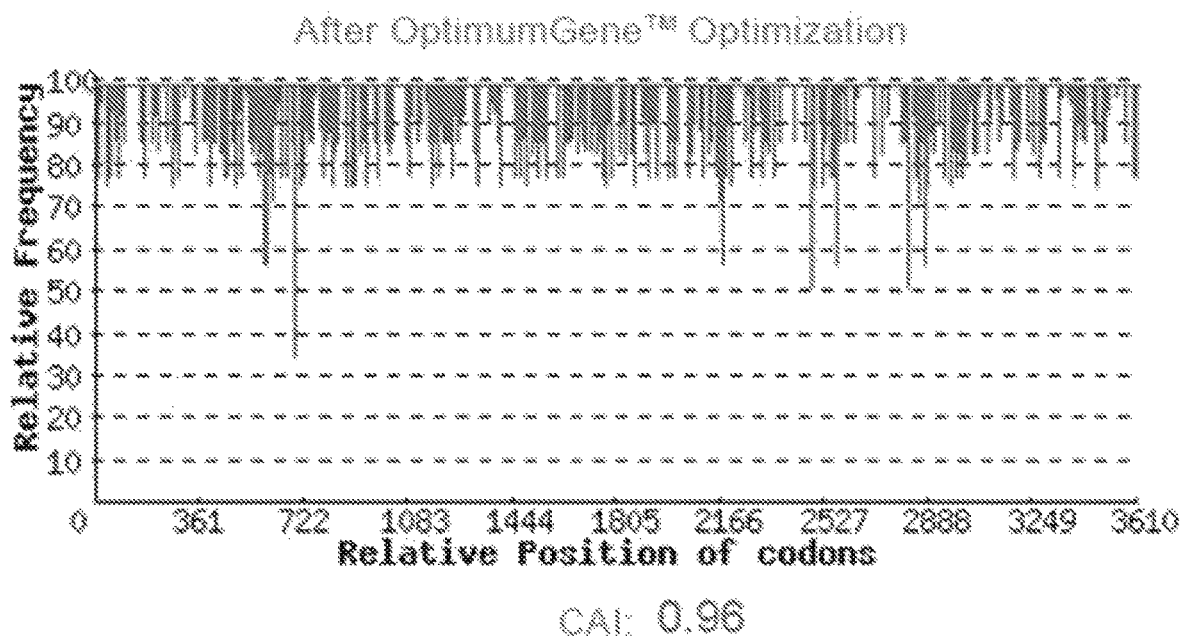
Figure 34B:
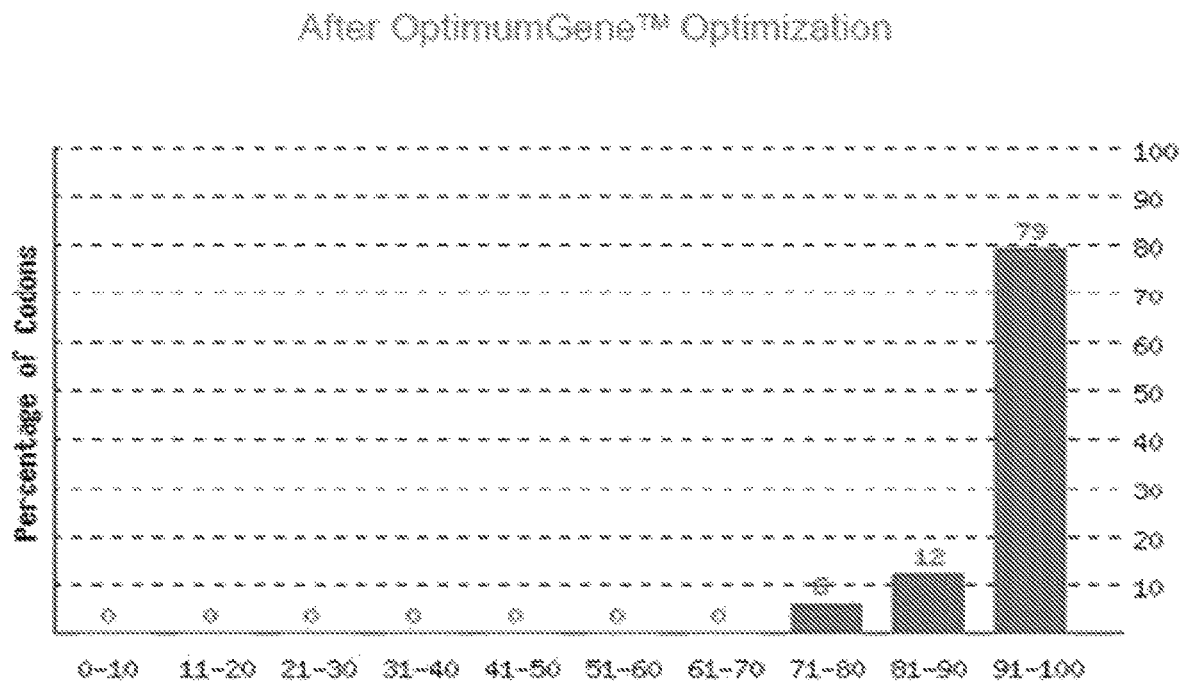
Figure 34C:
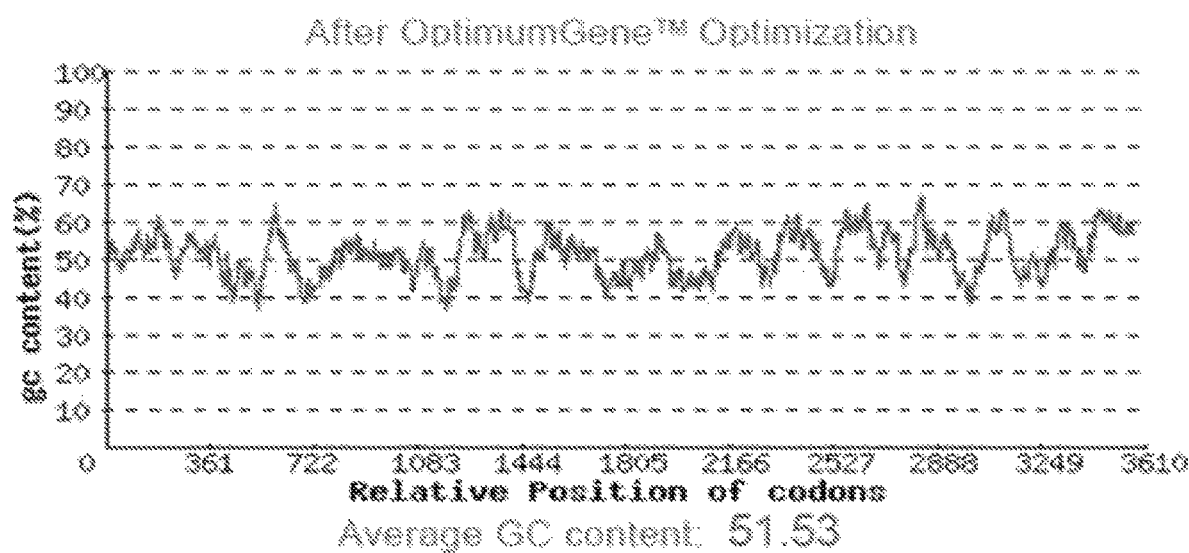
Figure 34F:
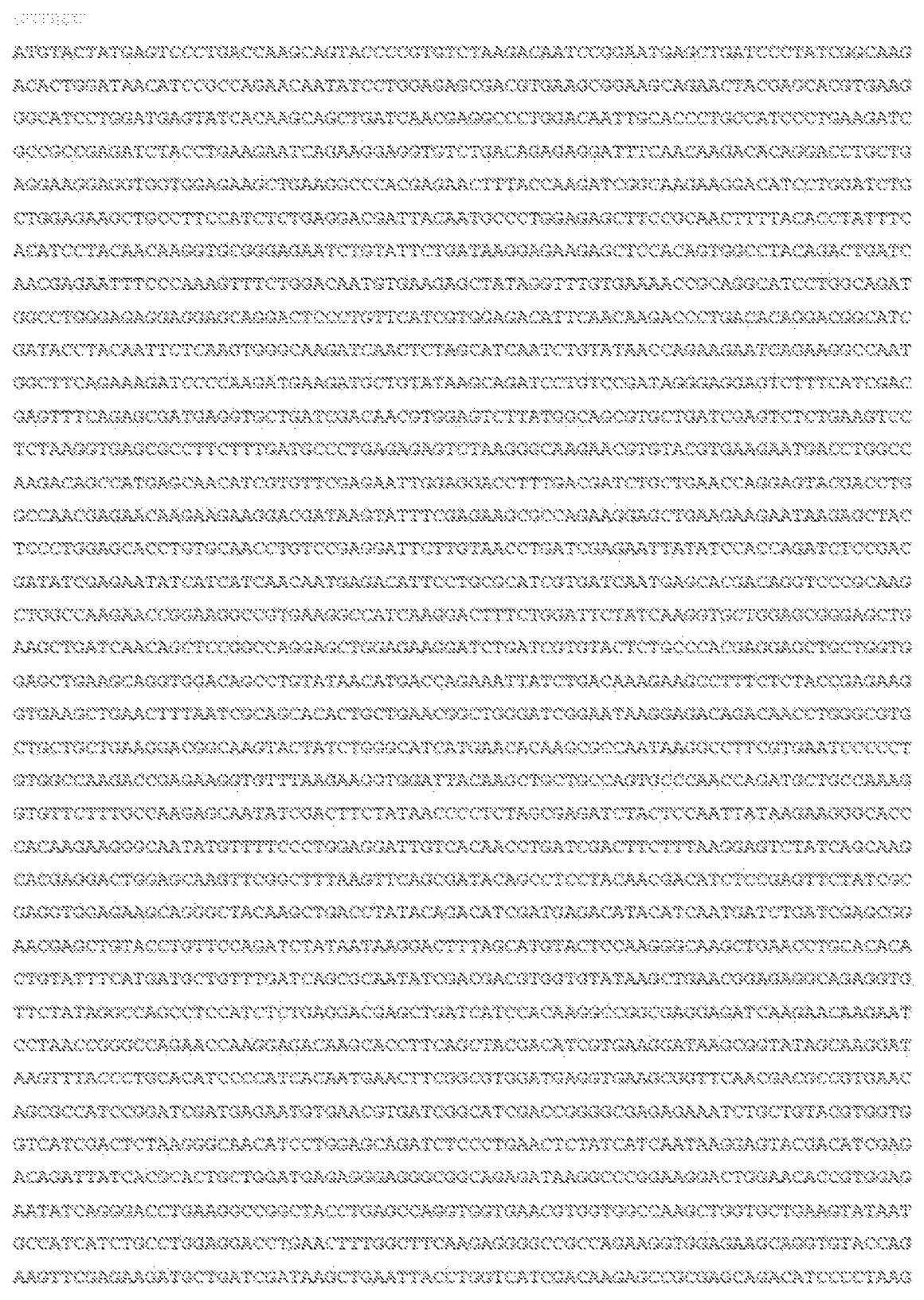

FIGS. 34A-34H show the details of the human codon optimized sequence for *Lachnospiraceae bacterium* MA2020 Cpf1 having a gene length of 3768 nts (Ref #9 in FIG. 27). FIG. 34A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 34B: Frequency of Optimal Codons (FOP). The percentage distribution of codons in computed codon quality groups. The value of 100 is set for the codon with the highest usage frequency for a given amino acid in the desired expression organism. FIG. 34C: GC Content Adjustment. The ideal percentage range of GC content is between 30-70%. Peaks of % GC content in a 60 bp window have been removed. FIG. 34D: Restriction Enzymes and CIS-Acting Elements. FIG. 71E: Remove Repeat Sequences. FIG. 34F-G: Optimized Sequence (Optimized Sequence Length: 3768, GC % 51.53) (SEQ ID NO: 445). FIG. 34H: Protein Sequence (SEQ ID NO: 446).

Figure 35A:
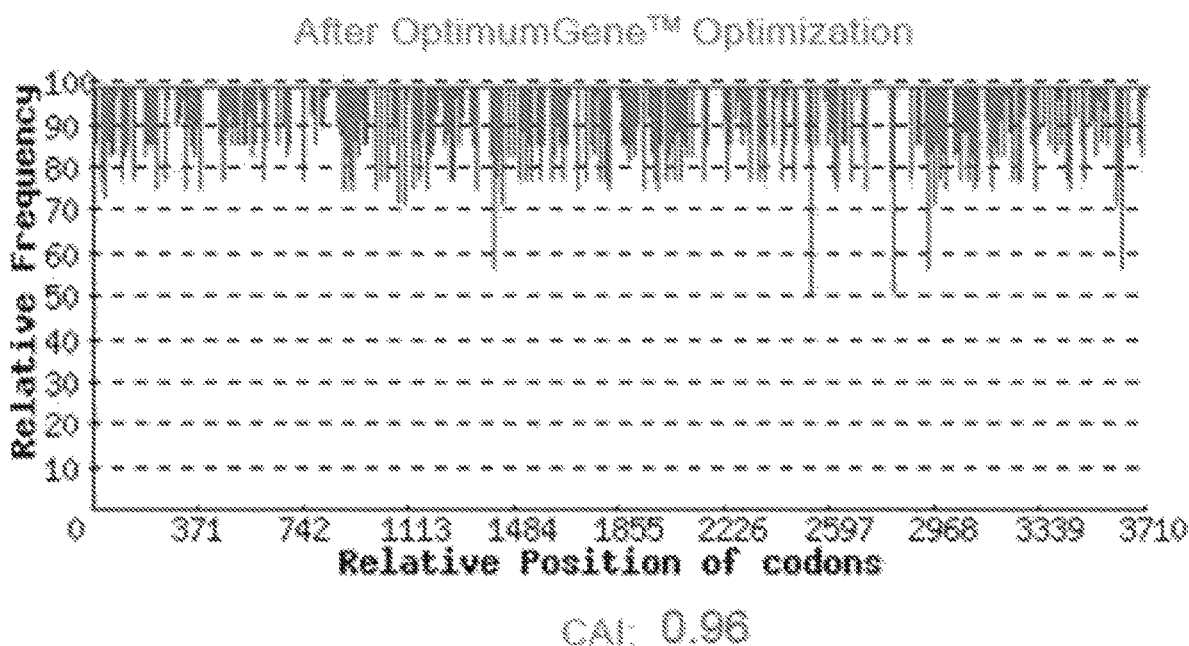
Figure 35B:
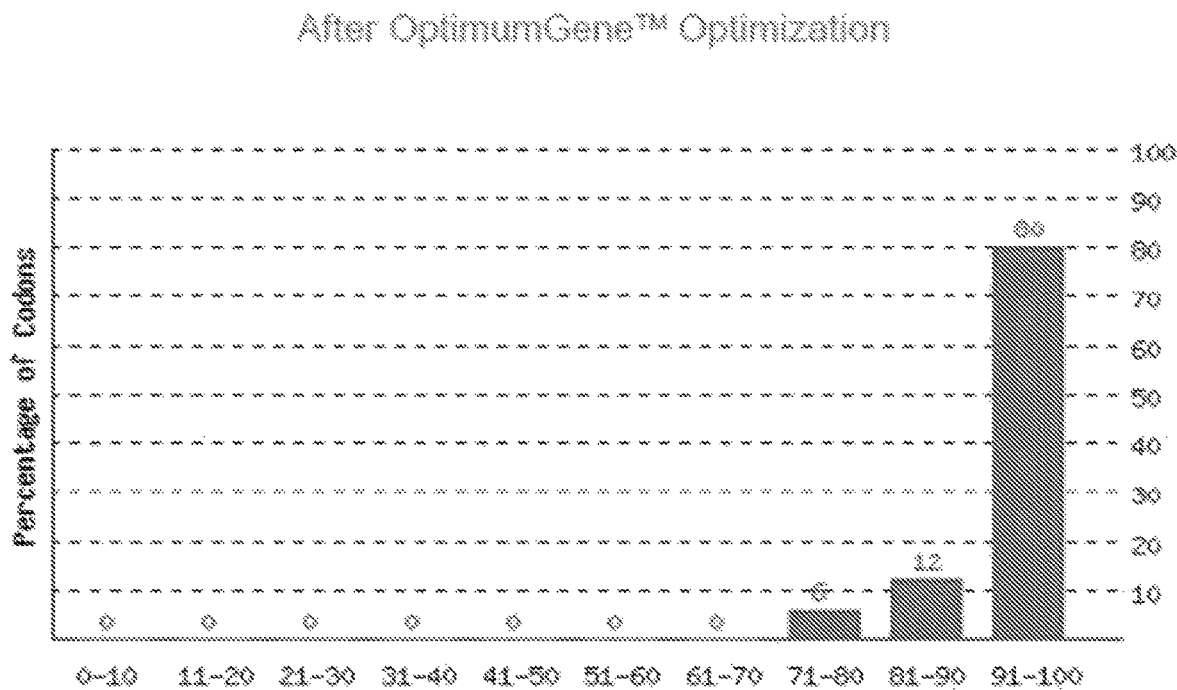
Figure 35C:
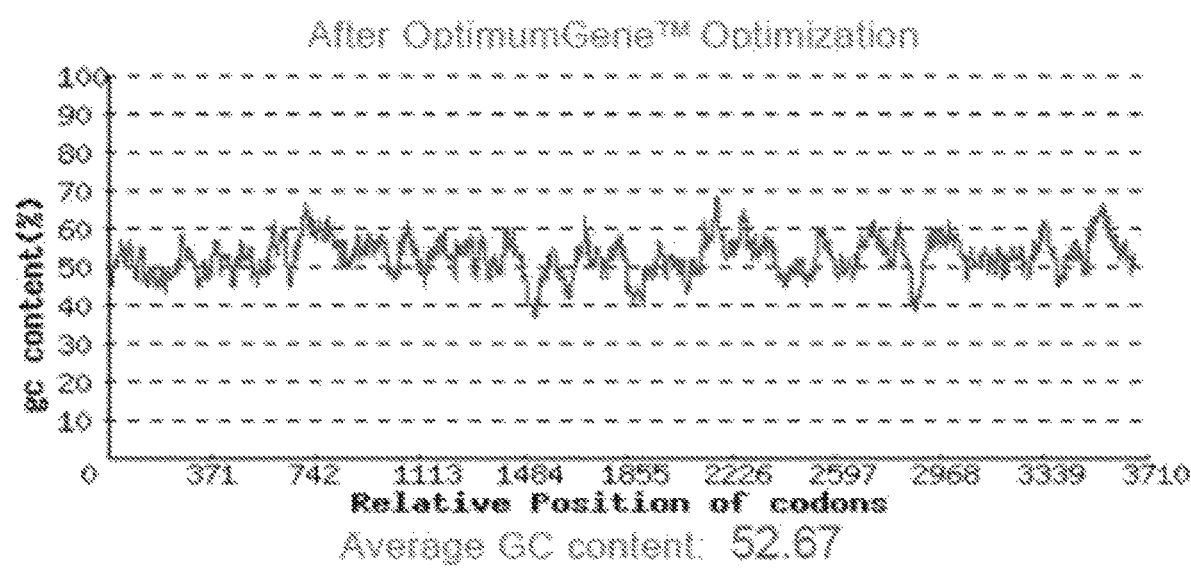
Figure 35F:
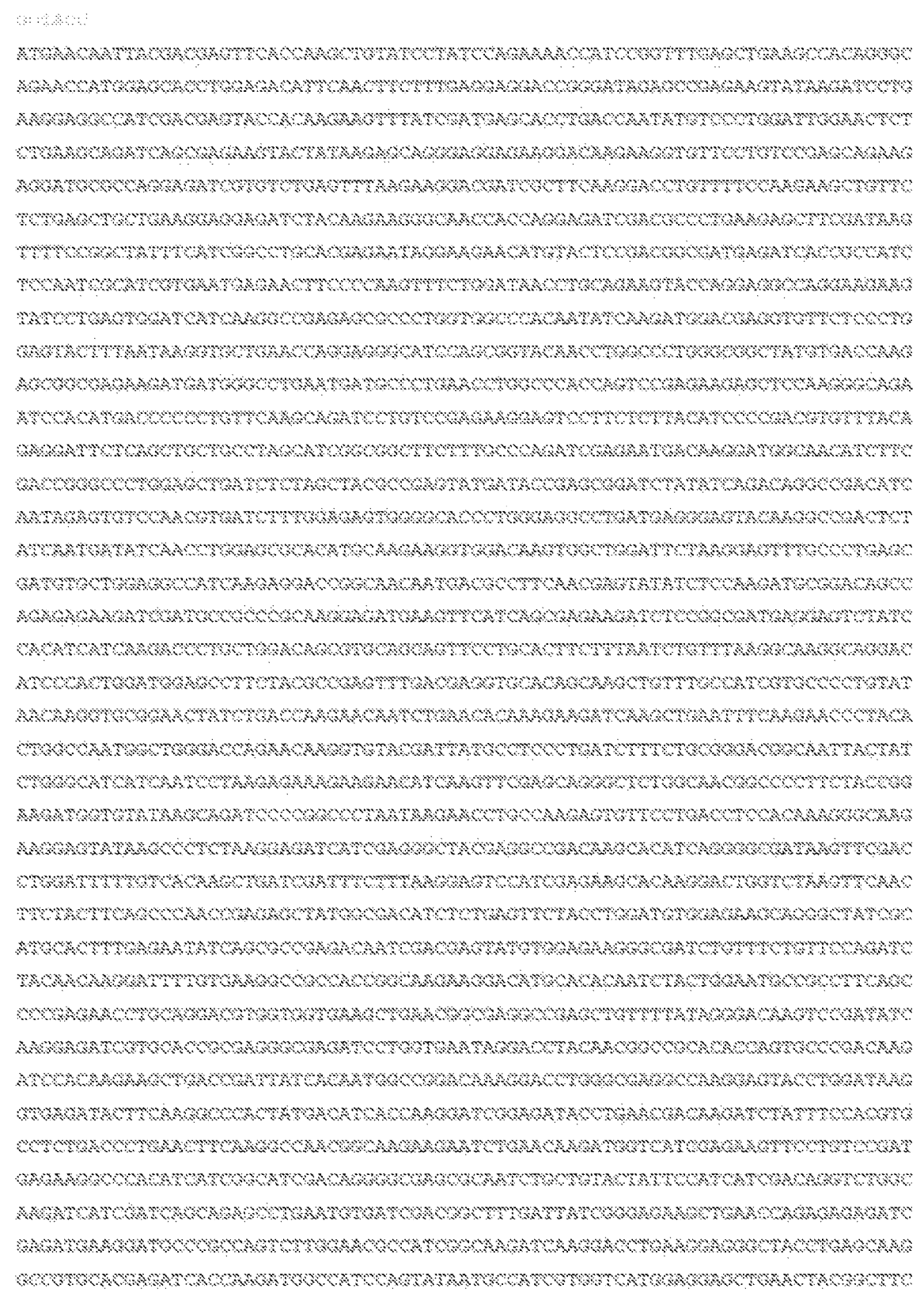

FIGS. 35A-35H show the details of the human codon optimized sequence for *Candidatus Methanoplasma termitum* Cpf1 having a gene length of 3864 nts (Ref #10 in FIG. 27). FIG. 35A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 35B: Frequency of Optimal Codons (FOP). The percentage distribution of codons in computed codon quality groups. The value of 100 is set for the codon with the highest usage frequency for a given amino acid in the desired expression organism. FIG. 35C: GC Content Adjustment. The ideal percentage range of GC content is between 30-70%. Peaks of % GC content in a 60 bp window have been removed. FIG. 35D: Restriction Enzymes and CIS-Acting Elements. FIG. 35E: Remove Repeat Sequences. FIG. 35F-G: Optimized Sequence (Optimized Sequence Length: 3864, GC % 52.67) (SEQ ID NO: 447). FIG. 35H: Protein Sequence (SEQ ID NO: 448).

Figure 36A:
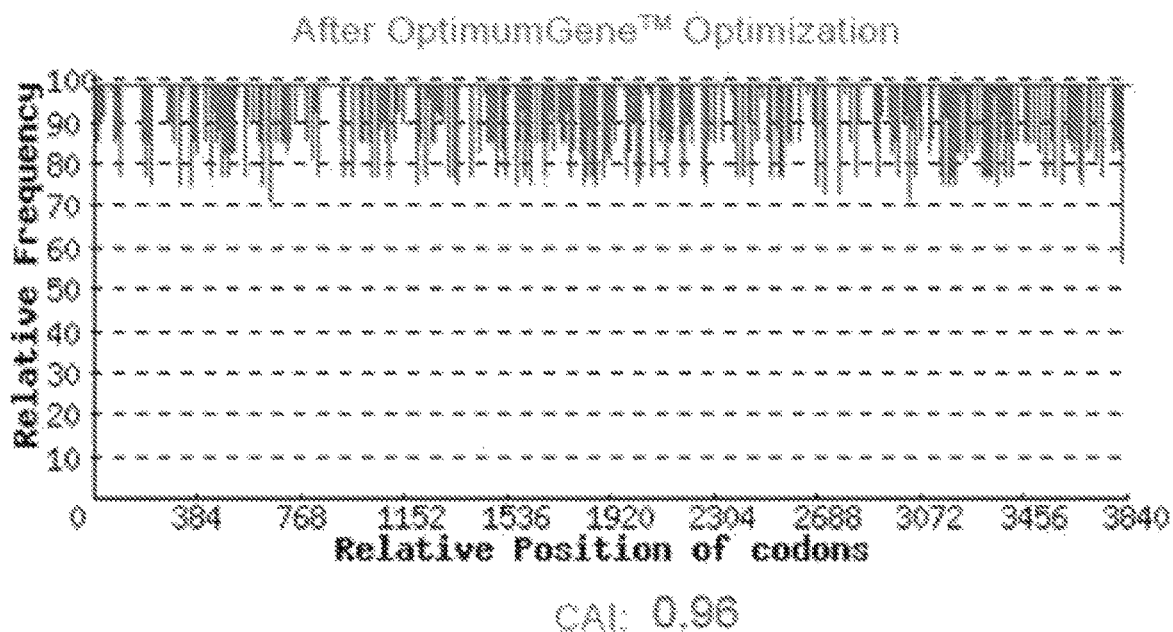
Figure 36B:
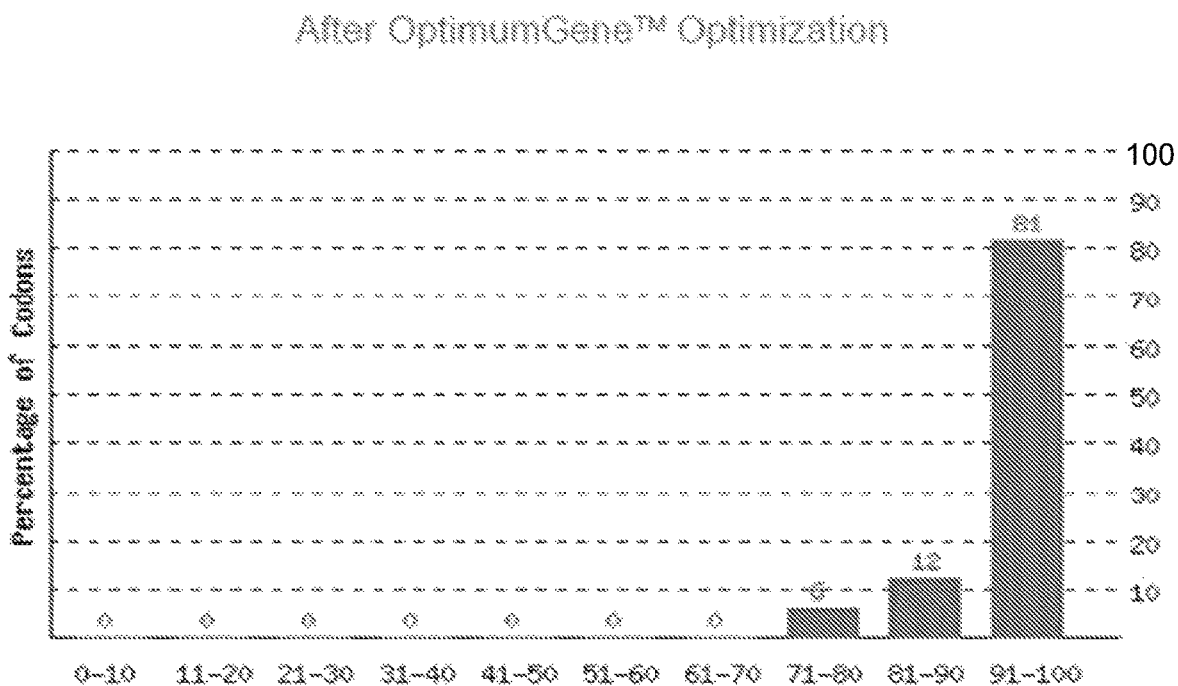
Figure 36C:
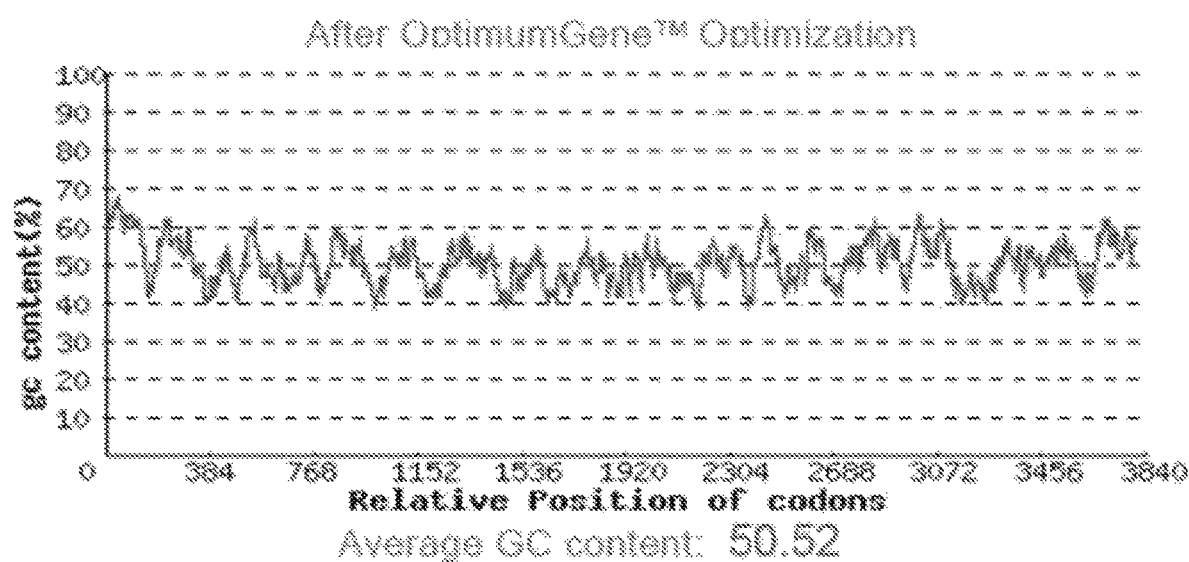
Figure 36F:
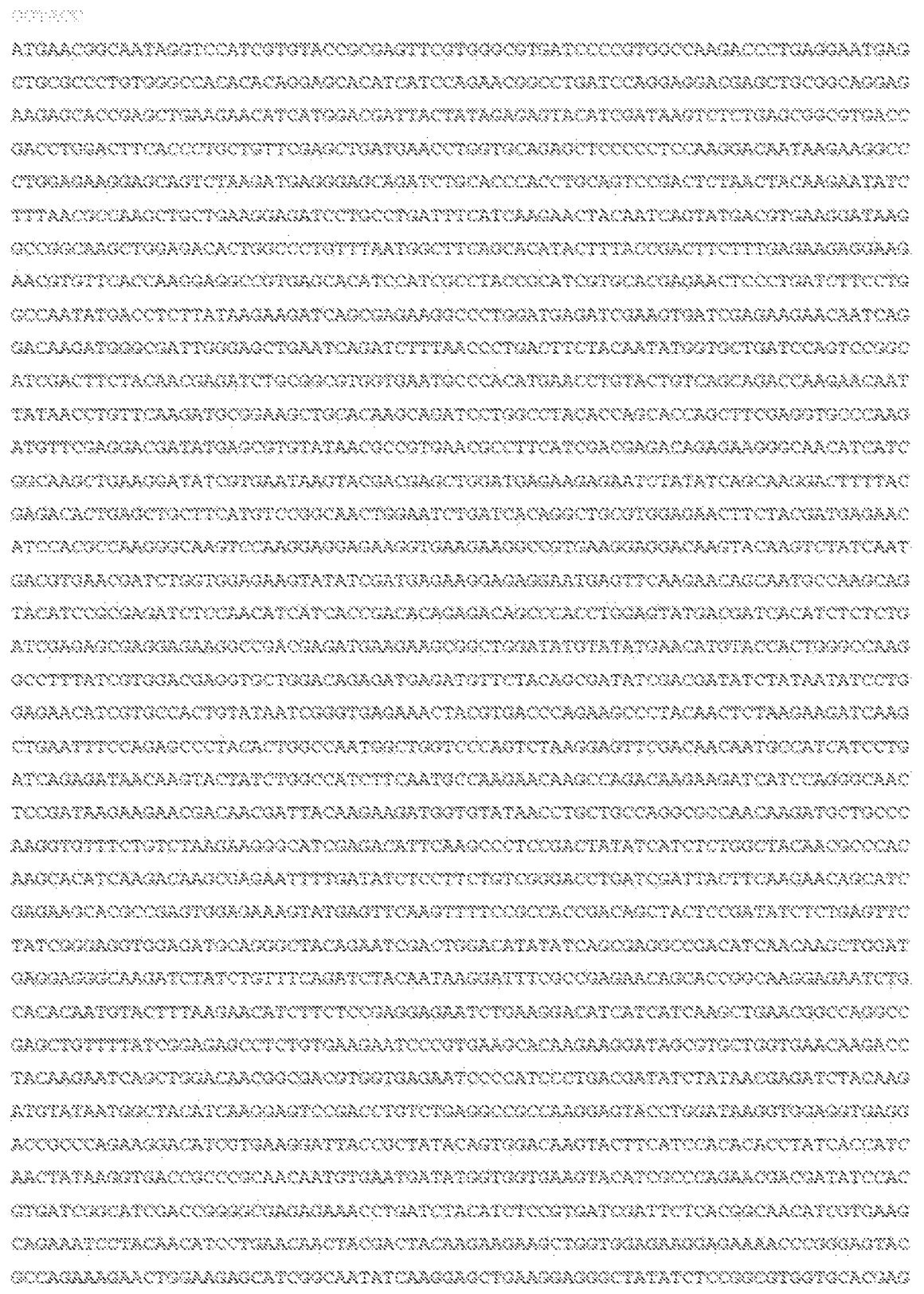

FIGS. 36A-36H show the details of the human codon optimized sequence for *Eubacterium* eligens Cpf1 having a gene length of 3996 nts (Ref #11 in FIG. 27). FIG. 36A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 36B: Frequency of Optimal Codons (FOP). The percentage distribution of codons in computed codon quality groups. The value of 100 is set for the codon with the highest usage frequency for a given amino acid in the desired expression organism. FIG. 36C: GC Content Adjustment. The ideal percentage range of GC content is between 30-70%. Peaks of % GC content in a 60 bp window have been removed. FIG. 36D: Restriction Enzymes and CIS-Acting Elements. FIG. 36E: Remove Repeat Sequences. FIG. 36F-G: Optimized Sequence (Optimized Sequence Length: 3996, GC % 50.52) (SEQ ID NO: 449). FIG. 36H: Protein Sequence (SEQ ID NO: 450).

Figure 37A:
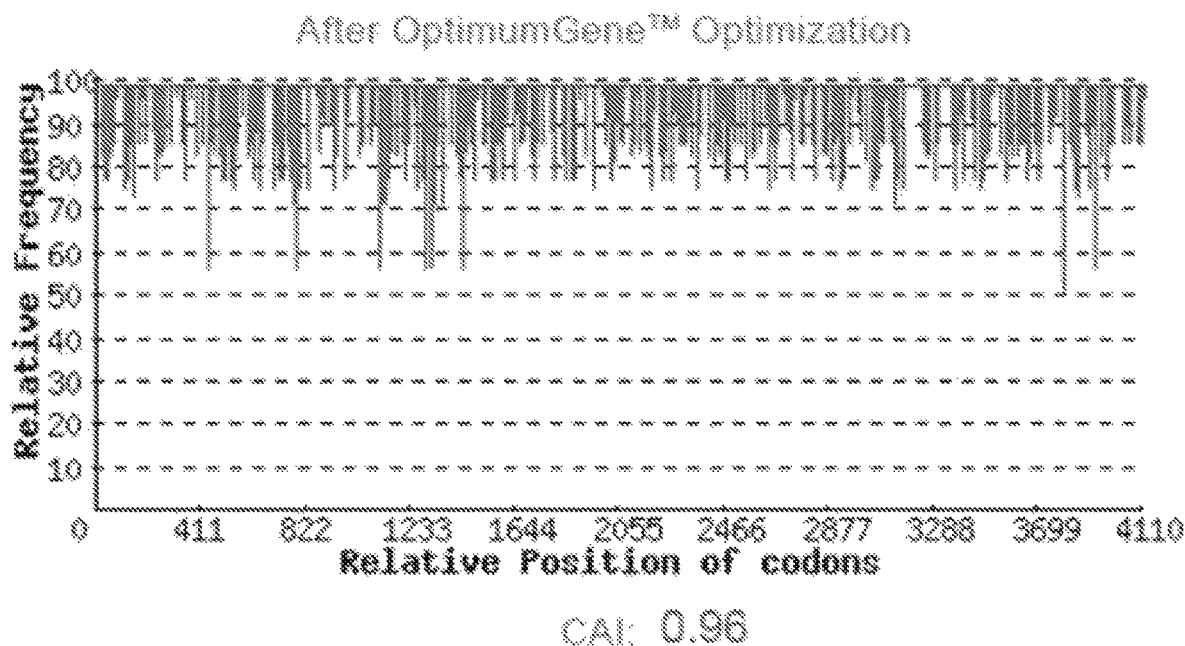
Figure 37B:
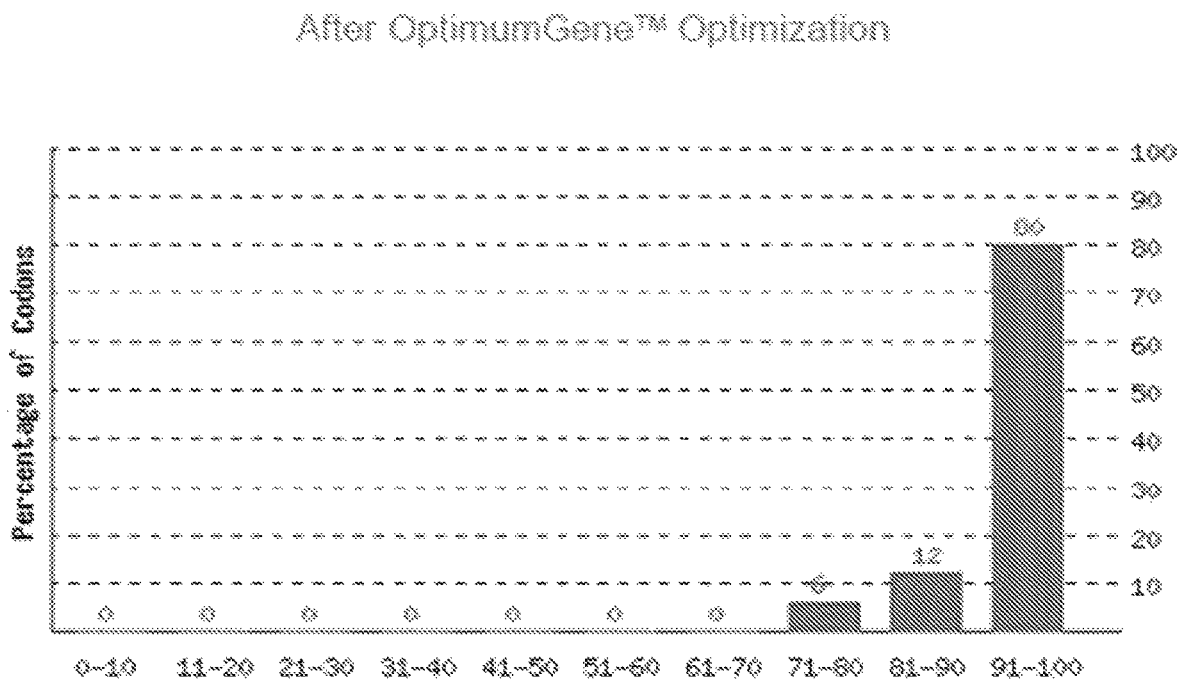
Figure 37C:
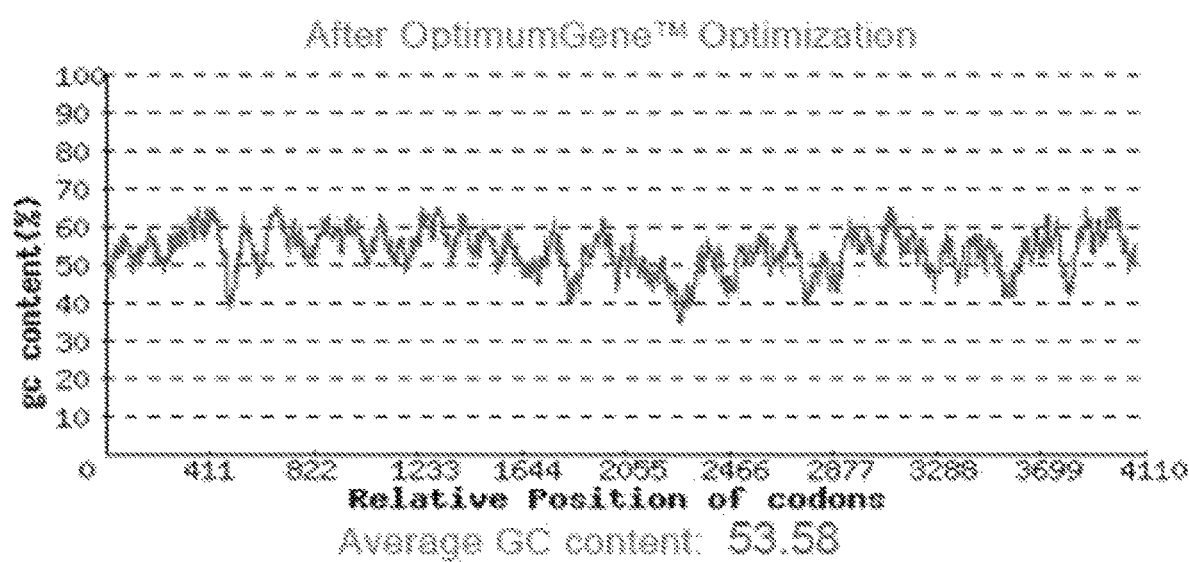
Figure 37F:
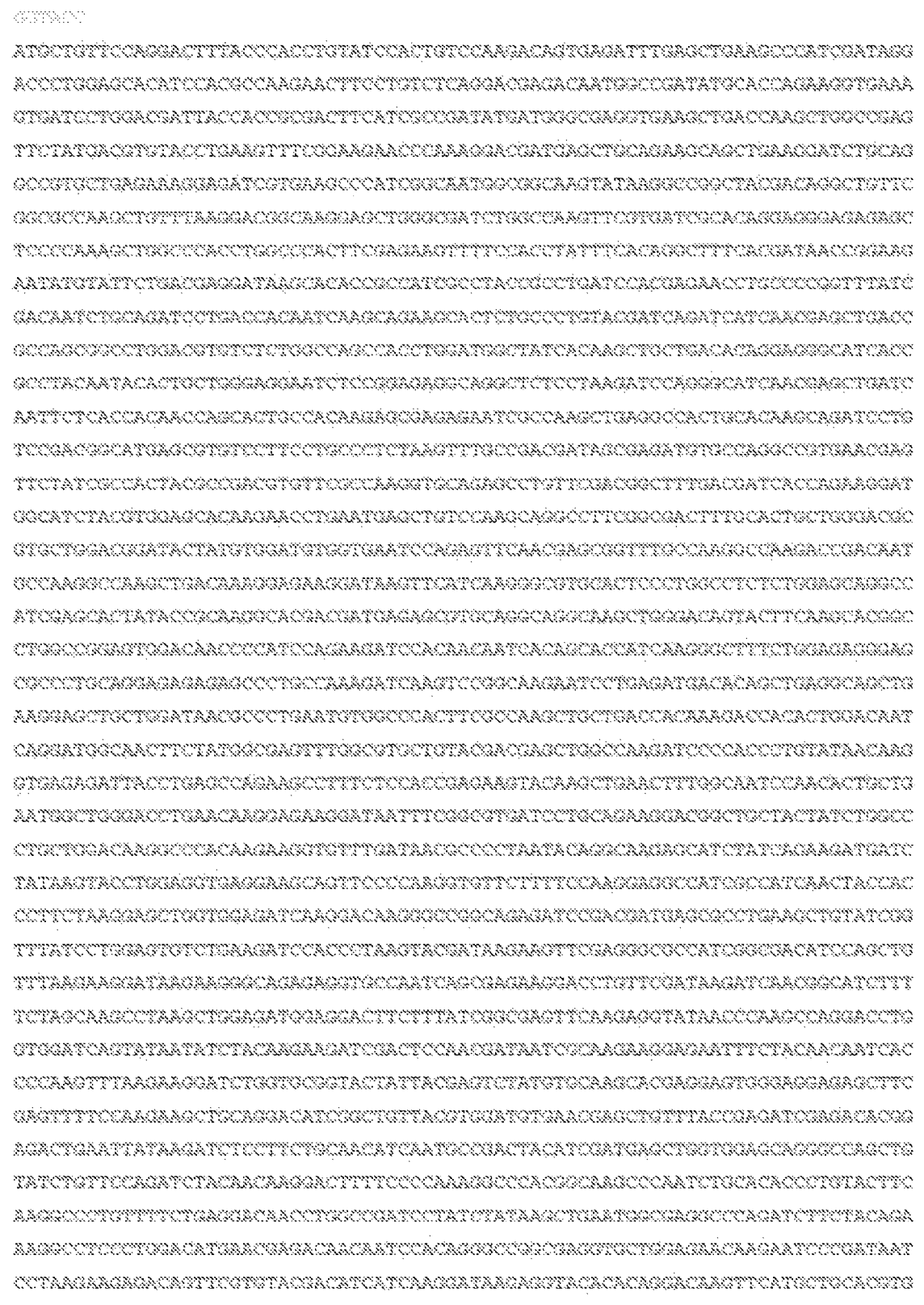

FIGS. 37A-37H show the details of the human codon optimized sequence for *Moraxella bovoculi* 237 Cpf1 having a gene length of 4269 nts (Ref #12 in FIG. 27). FIG. 37A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 37B: Frequency of Optimal Codons (FOP). The percentage distribution of codons in computed codon quality groups. The value of 100 is set for the codon with the highest usage frequency for a given amino acid in the desired expression organism. FIG. 37C: GC Content Adjustment. The ideal percentage range of GC content is between 30-70%. Peaks of % GC content in a 60 bp window have been removed. FIG. 37D: Restriction Enzymes and CIS-Acting Elements. FIG. 37E: Remove Repeat Sequences. FIG. 37F-G: Optimized Sequence (Optimized Sequence Length: 4269, GC % 53.58) (SEQ ID NO: 451). FIG. 74H: Protein Sequence (SEQ ID NO: 452).

Figure 38A:
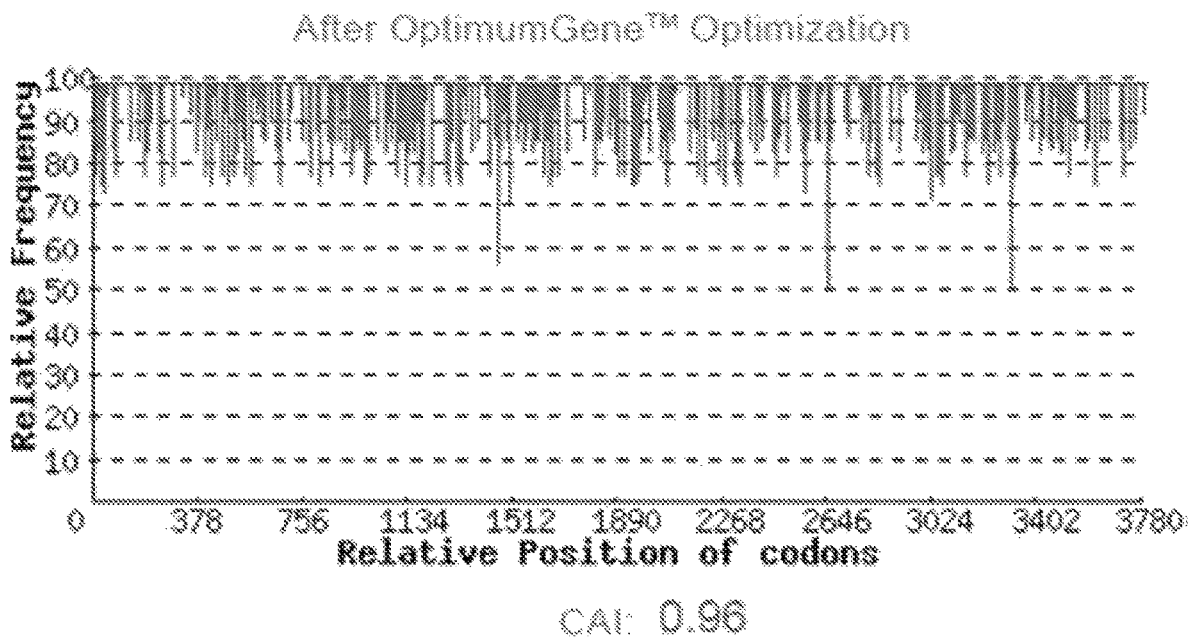
Figure 38B:
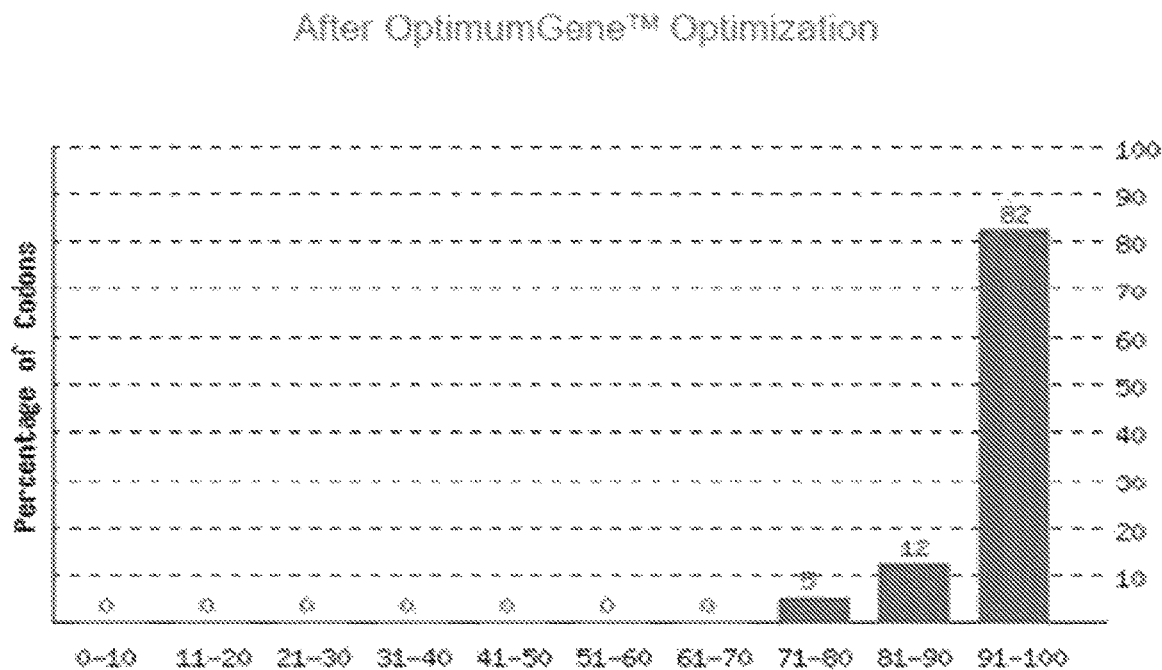
Figure 38C:
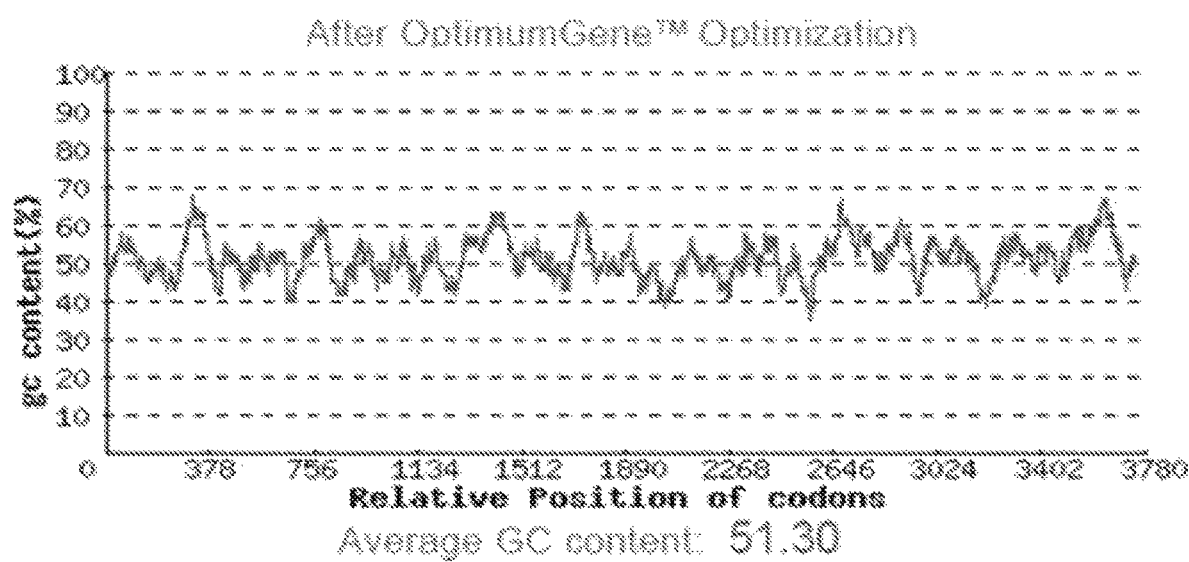
Figure 38F:
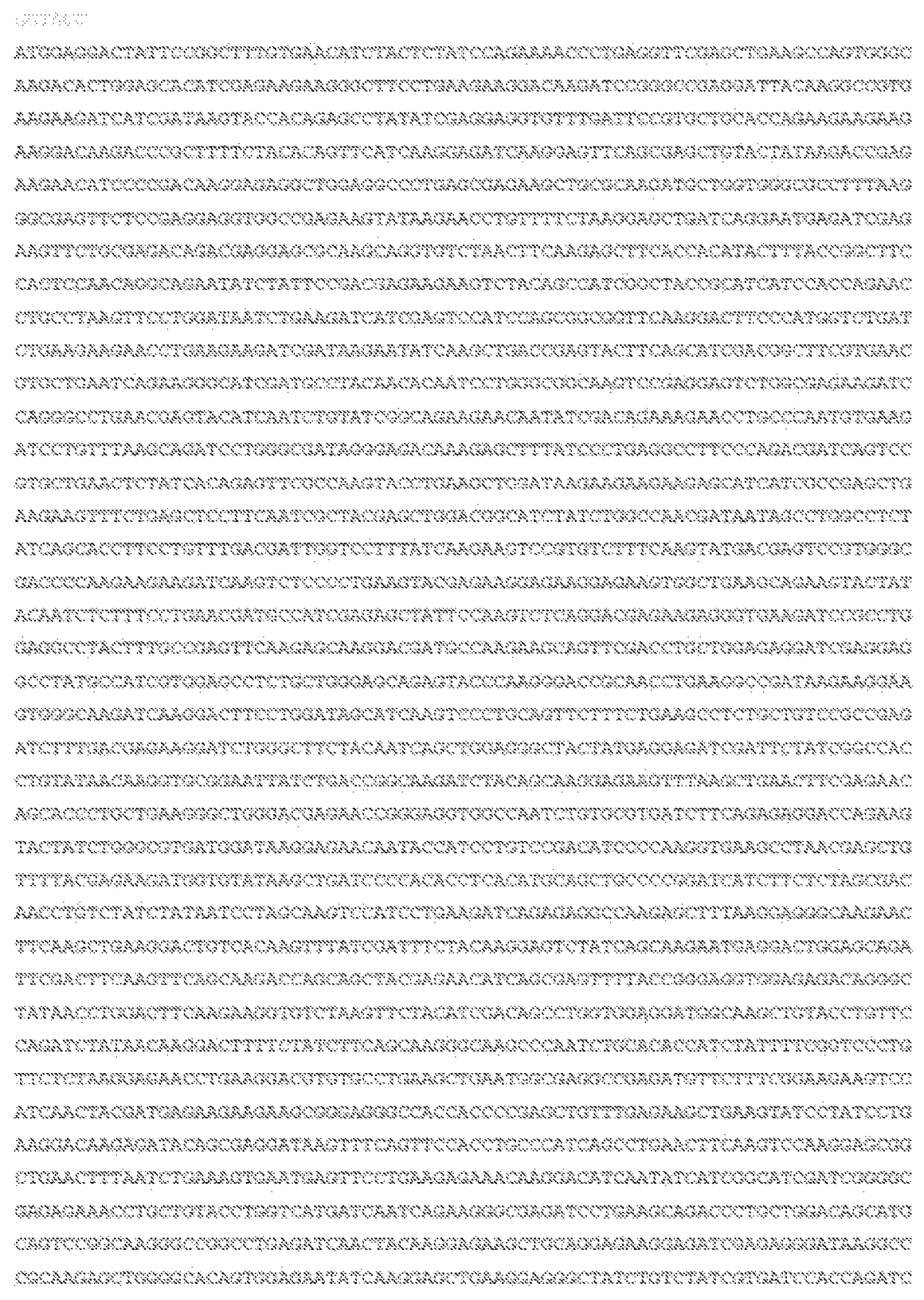

FIGS. 38A-38H show the details of the human codon optimized sequence for *Leptospira inadai* Cpf1 having a gene length of 3939 nts (Ref #13 in FIG. 27). FIG. 38A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 38B: Frequency of Optimal Codons (FOP). The percentage distribution of codons in computed codon quality groups. The value of 100 is set for the codon with the highest usage frequency for a given amino acid in the desired expression organism. FIG. 38C: GC Content Adjustment. The ideal percentage range of GC content is between 30-70%. Peaks of % GC content in a 60 bp window have been removed. FIG. 38D: Restriction Enzymes and CIS-Acting Elements. FIG. 38E: Remove Repeat Sequences. FIG. 38F-G: Optimized Sequence (Optimized Sequence Length: 3939, GC % 51.30) (SEQ ID NO: 453). FIG. 38H: Protein Sequence (SEQ ID NO: 454).

Figure 39A:
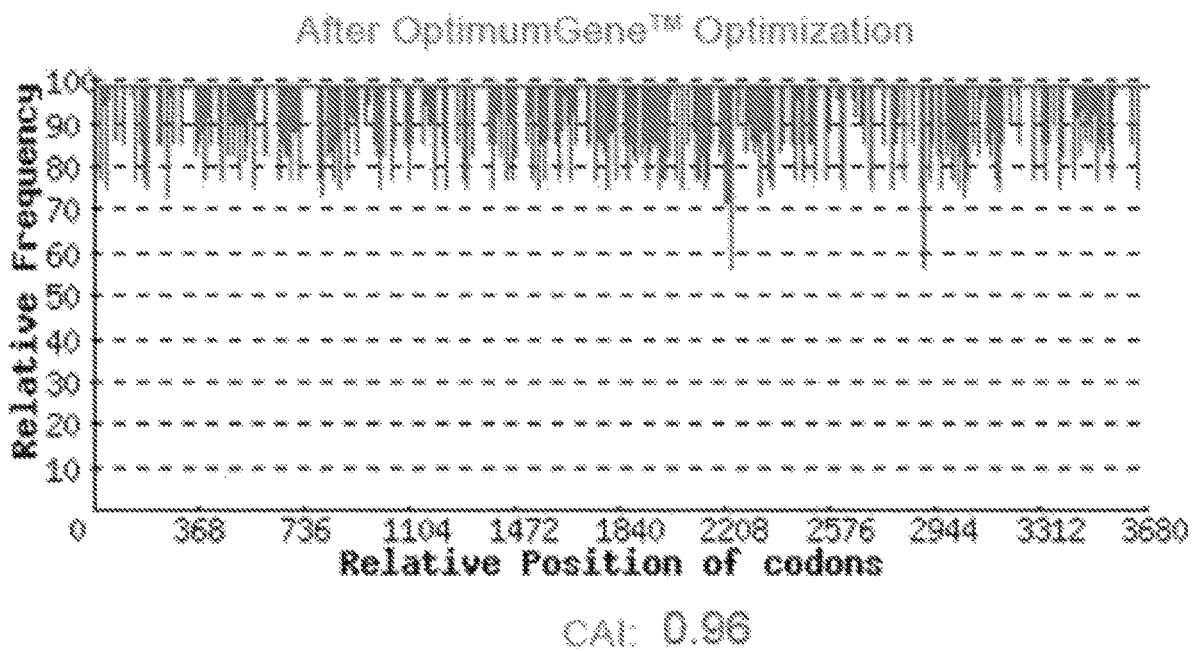
Figure 39B:
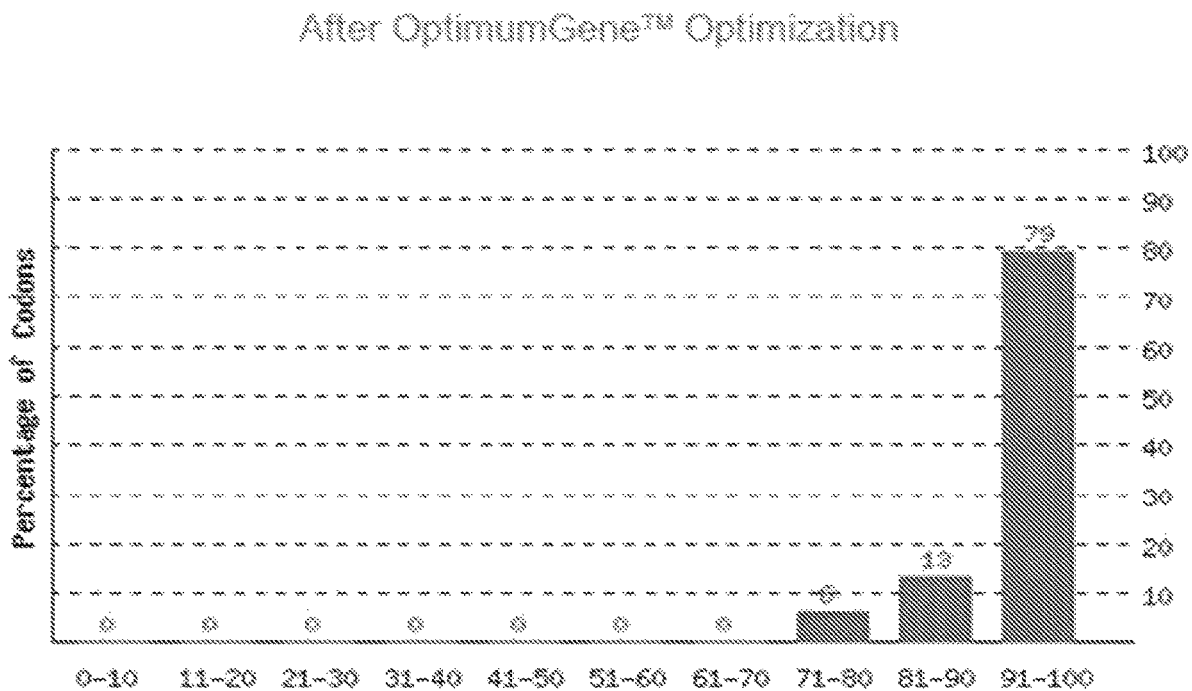
Figure 39C:
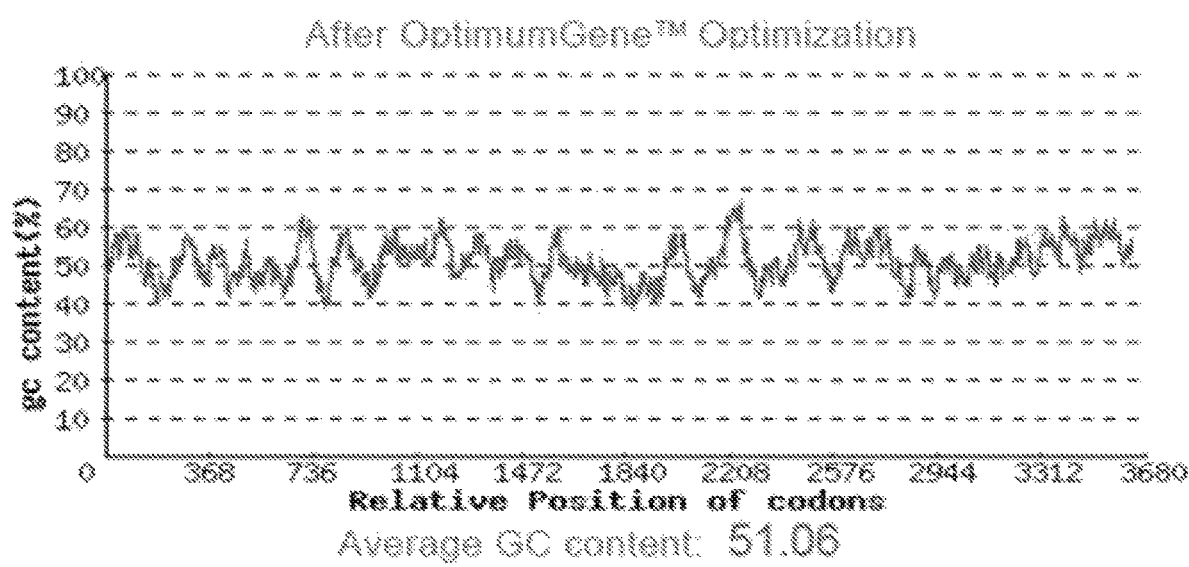
Figure 39F:
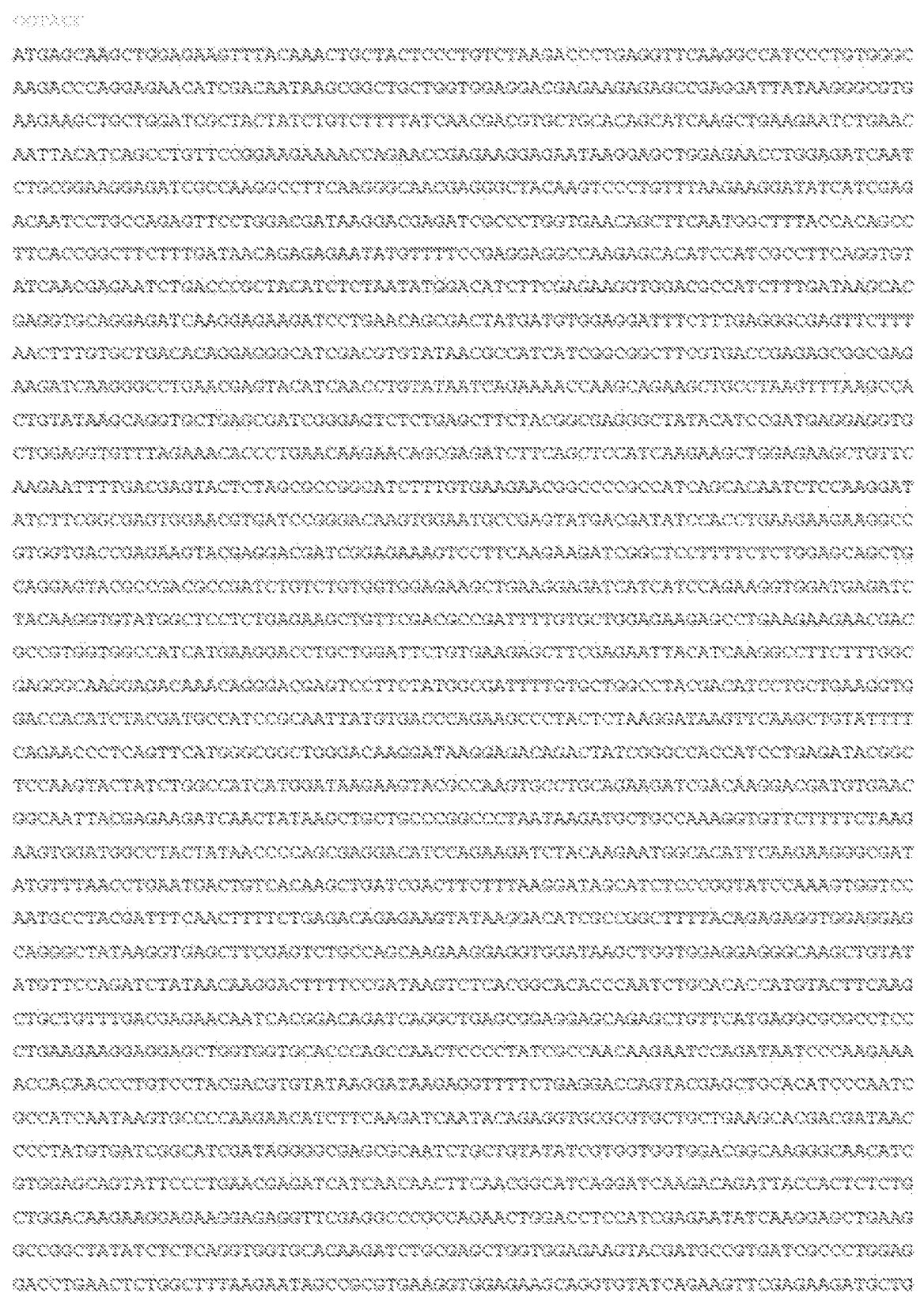

FIGS. 39A-39H show the details of the human codon optimized sequence for *Lachnospiraceae bacterium* ND2006 Cpf1 having a gene length of 3834 nts (Ref #14 in FIG. 27). FIG. 39A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 39B: Frequency of Optimal Codons (FOP). The percentage distribution of codons in computed codon quality groups. The value of 100 is set for the codon with the highest usage frequency for a given amino acid in the desired expression organism. FIG. 39C: GC Content Adjustment. The ideal percentage range of GC content is between 30-70%. Peaks of % GC content in a 60 bp window have been removed. FIG. 39D: Restriction Enzymes and CIS-Acting Elements. FIG. 39E: Remove Repeat Sequences. FIG. 39F-G: Optimized Sequence (Optimized Sequence Length: 3834, GC % 51.06) (SEQ ID NO: 455). FIG. 39H: Protein Sequence (SEQ ID NO: 456).

Figure 40A:
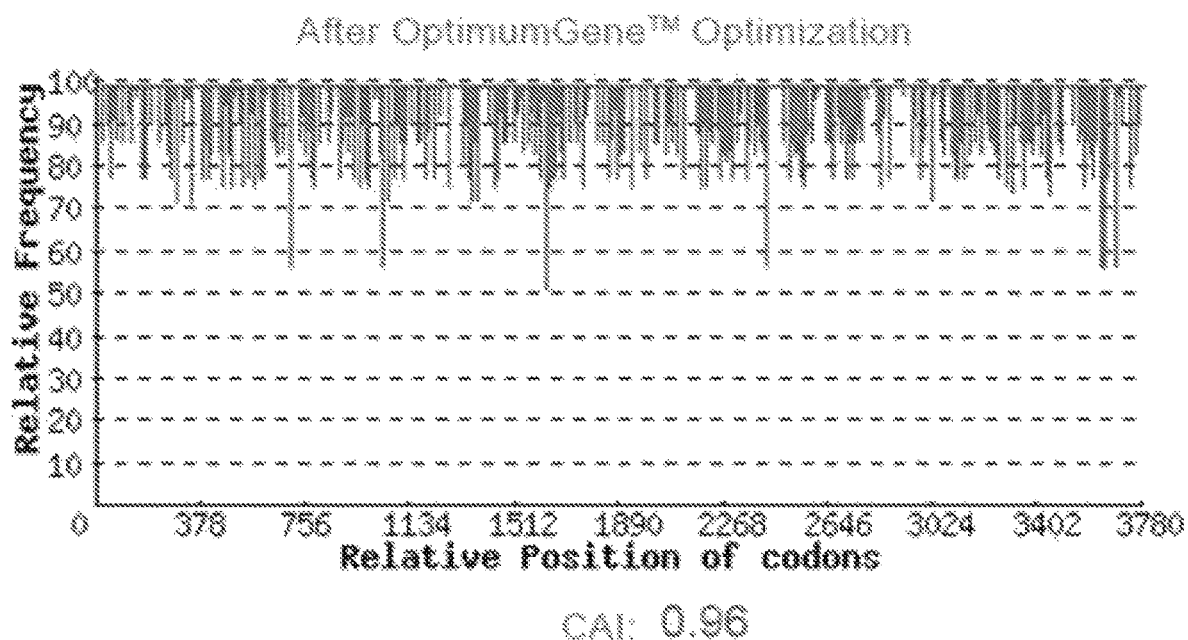
Figure 40B:
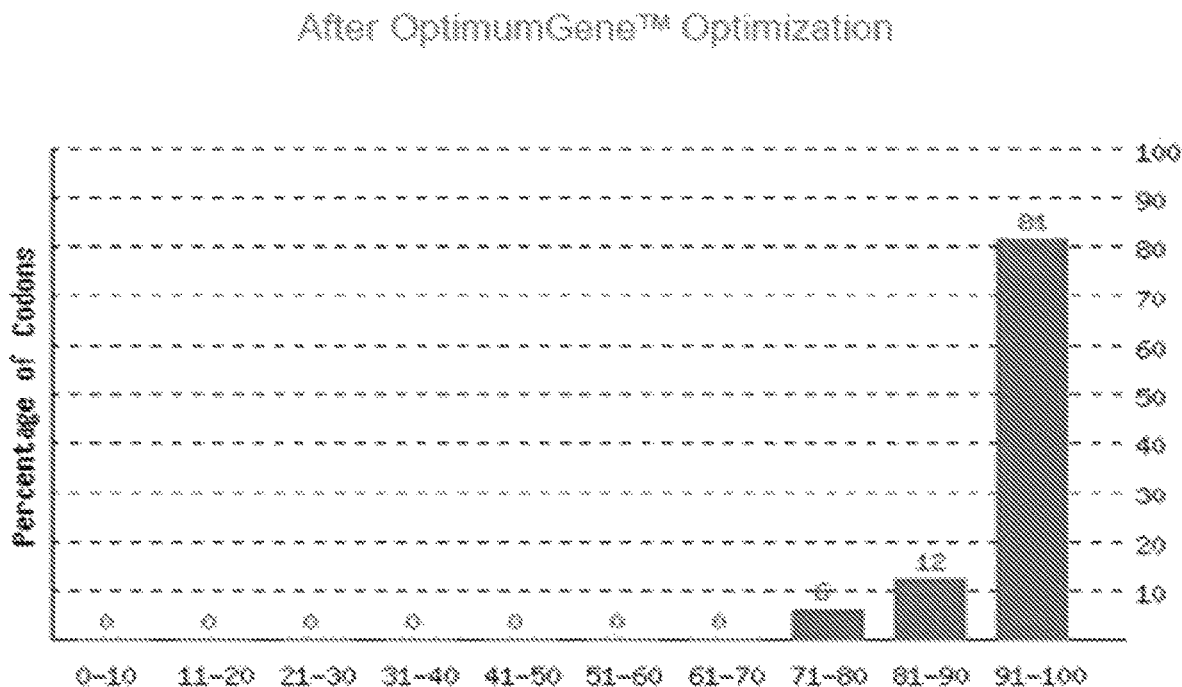
Figure 40F:
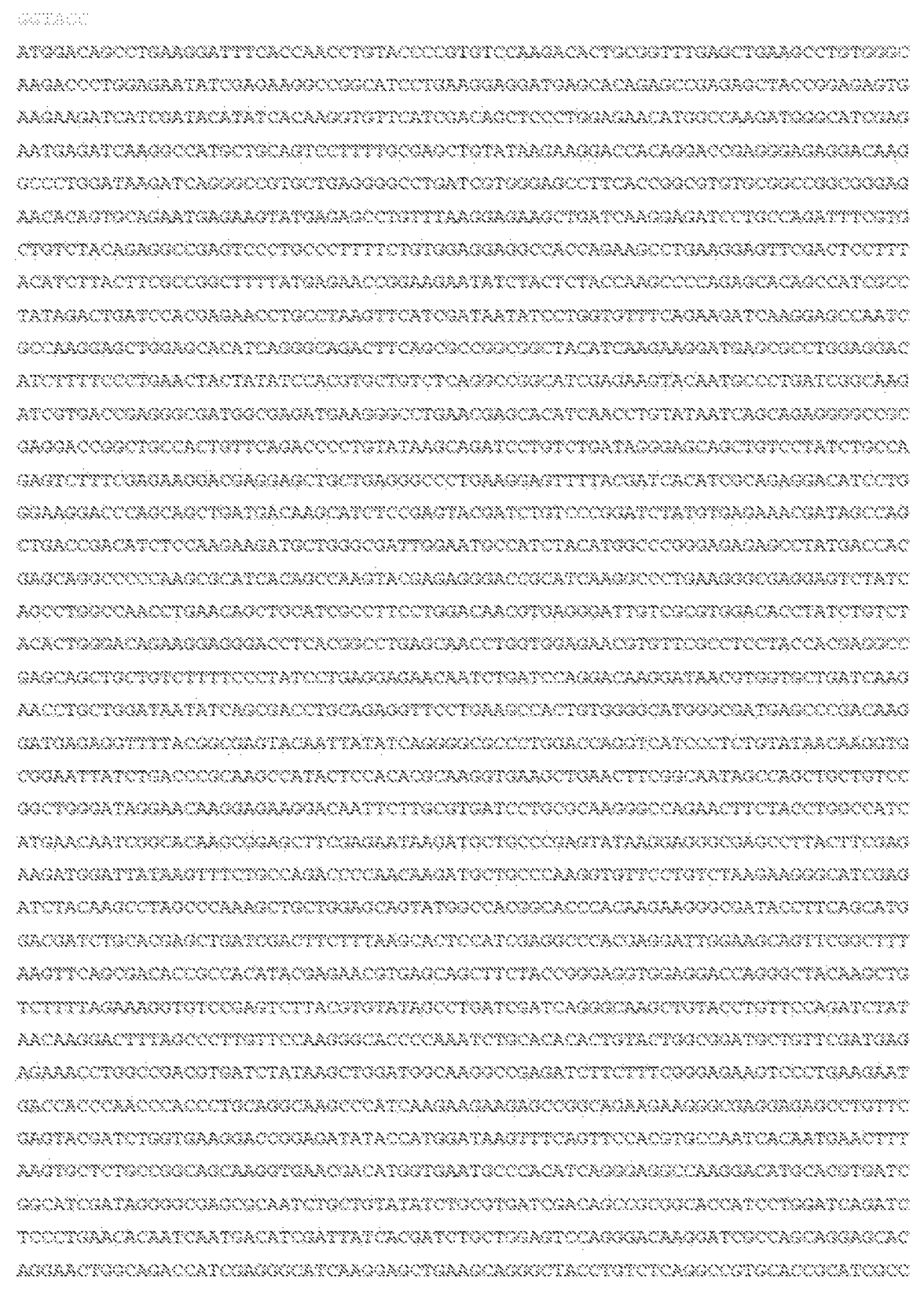
Figure 40C:
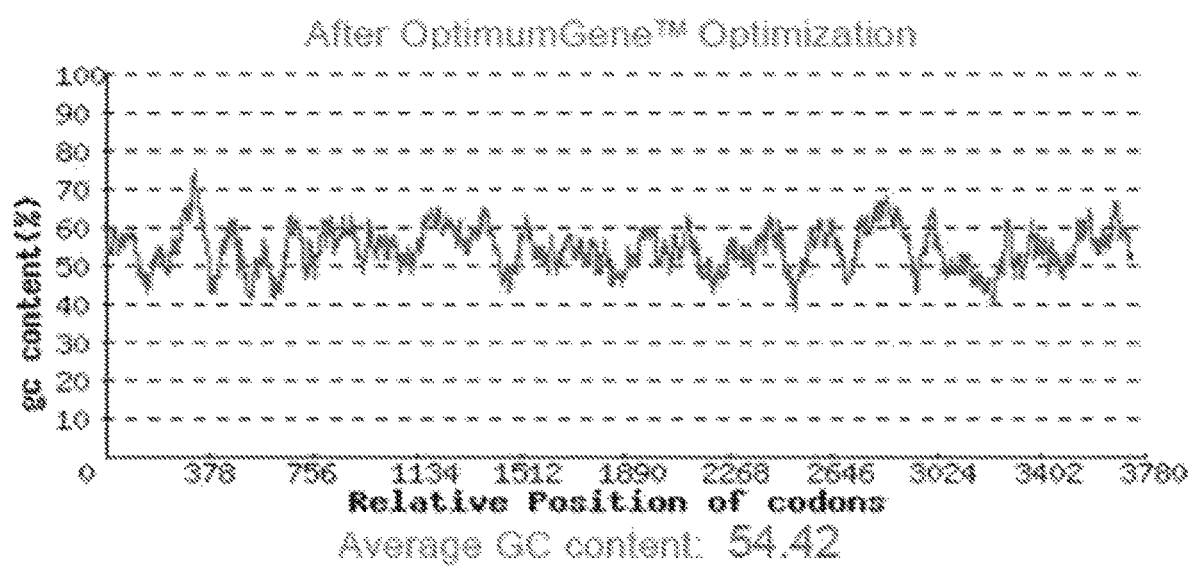

FIGS. 40A-40H show the details of the human codon optimized sequence for *Porphyromonas crevioricanis* 3 Cpf1 having a gene length of 3930 nts (Ref #15 in FIG. 27). FIG. 40A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 40B: Frequency of Optimal Codons (FOP). The percentage distribution of codons in computed codon quality groups. The value of 100 is set for the codon with the highest usage frequency for a given amino acid in the desired expression organism. FIG. 40C: GC Content Adjustment. The ideal percentage range of GC content is between 30-70%. Peaks of % GC content in a 60 bp window have been removed. FIG. 40D: Restriction Enzymes and CIS-Acting Elements. FIG. 40E: Remove Repeat Sequences. FIG. 40F-G: Optimized Sequence (Optimized Sequence Length: 3930, GC % 54.42) (SEQ ID NO: 457). FIG. 40H: Protein Sequence (SEQ ID NO: 458).

Figure 41A:
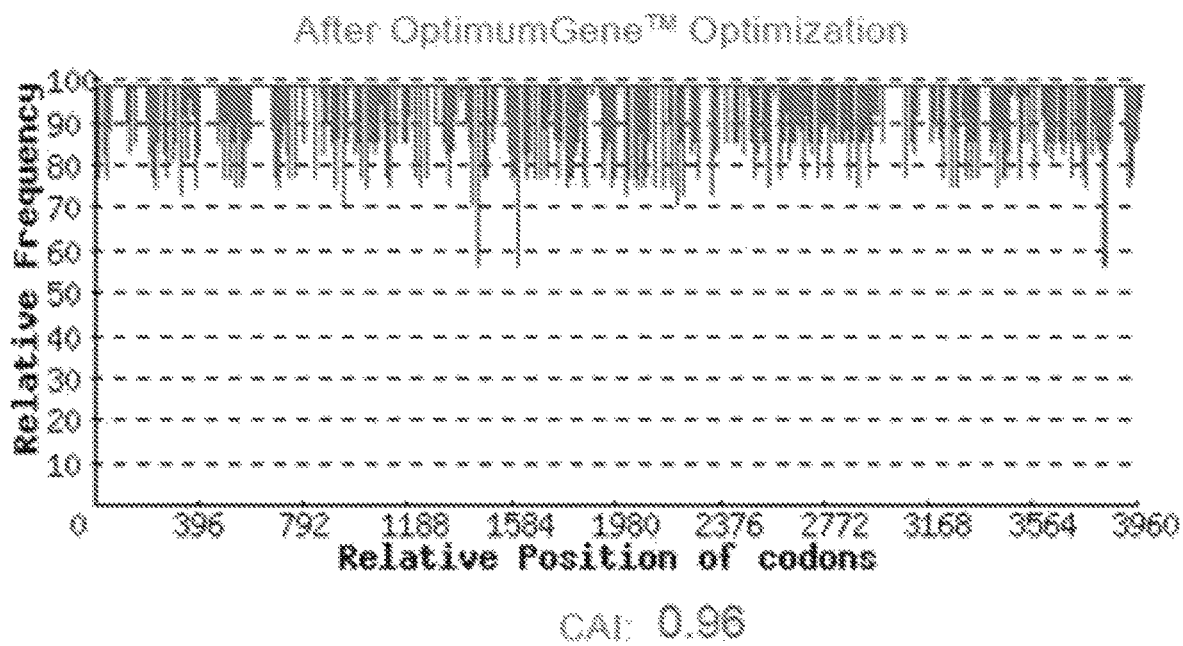
Figure 41B:
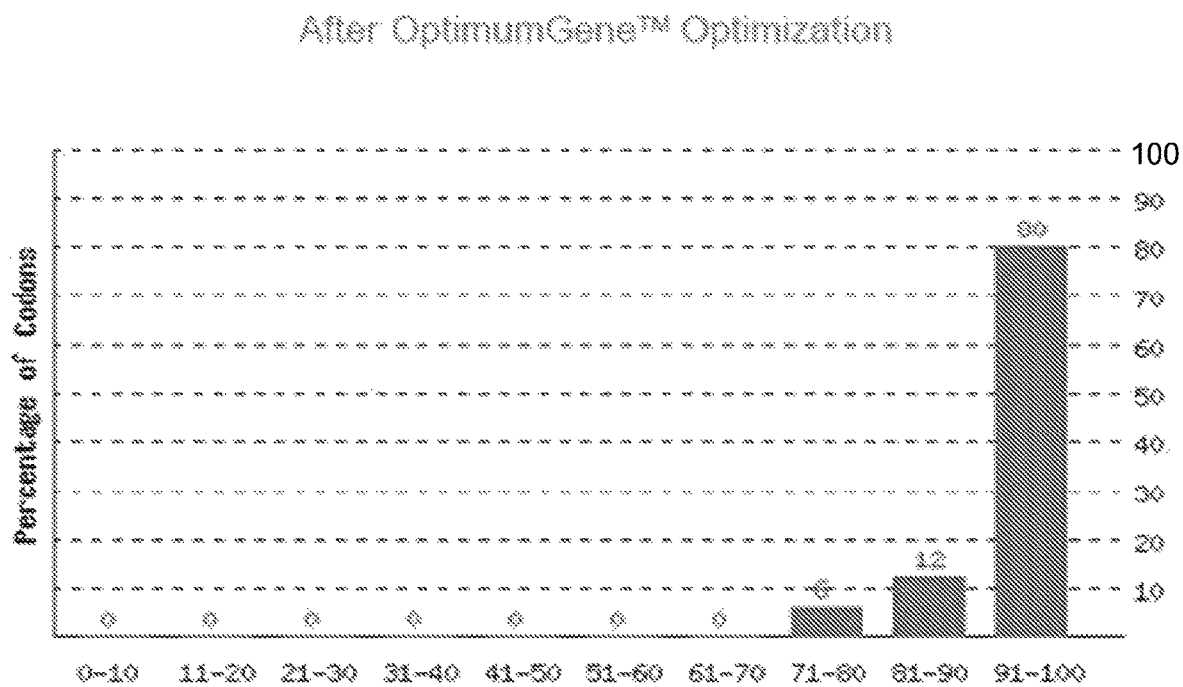
Figure 41C:
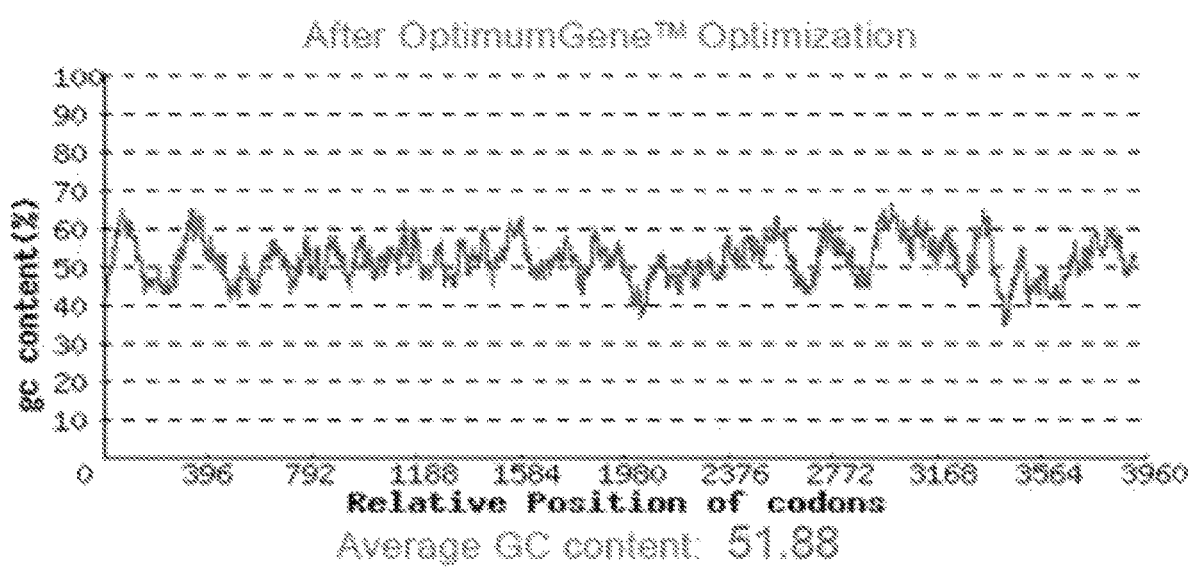

FIGS. 41A-41H show the details of the human codon optimized sequence for *Prevotella disiens* Cpf1 having a gene length of 4119 nts (Ref #16 in FIG. 27). FIG. 41A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 41B: Frequency of Optimal Codons (FOP). The percentage distribution of codons in computed codon quality groups. The value of 100 is set for the codon with the highest usage frequency for a given amino acid in the desired expression organism. FIG. 41C: GC Content Adjustment. The ideal percentage range of GC content is between 30-70%. Peaks of % GC content in a 60 bp window have been removed. FIG. 41D: Restriction Enzymes and CIS-Acting Elements. FIG. 41E: Remove Repeat Sequences. FIG. 41F-G: Optimized Sequence (Optimized Sequence Length: 4119, GC % 51.88) (SEQ ID NO: 459). FIG. 41H: Protein Sequence (SEQ ID NO: 460).

Figure 42A:
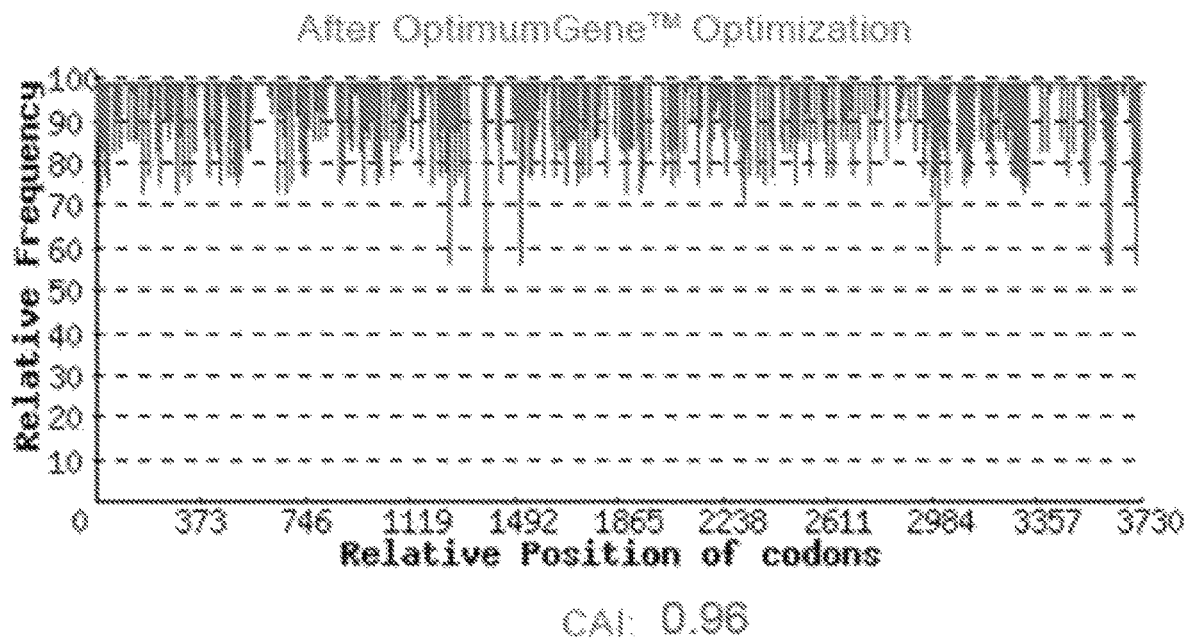
Figure 42B:
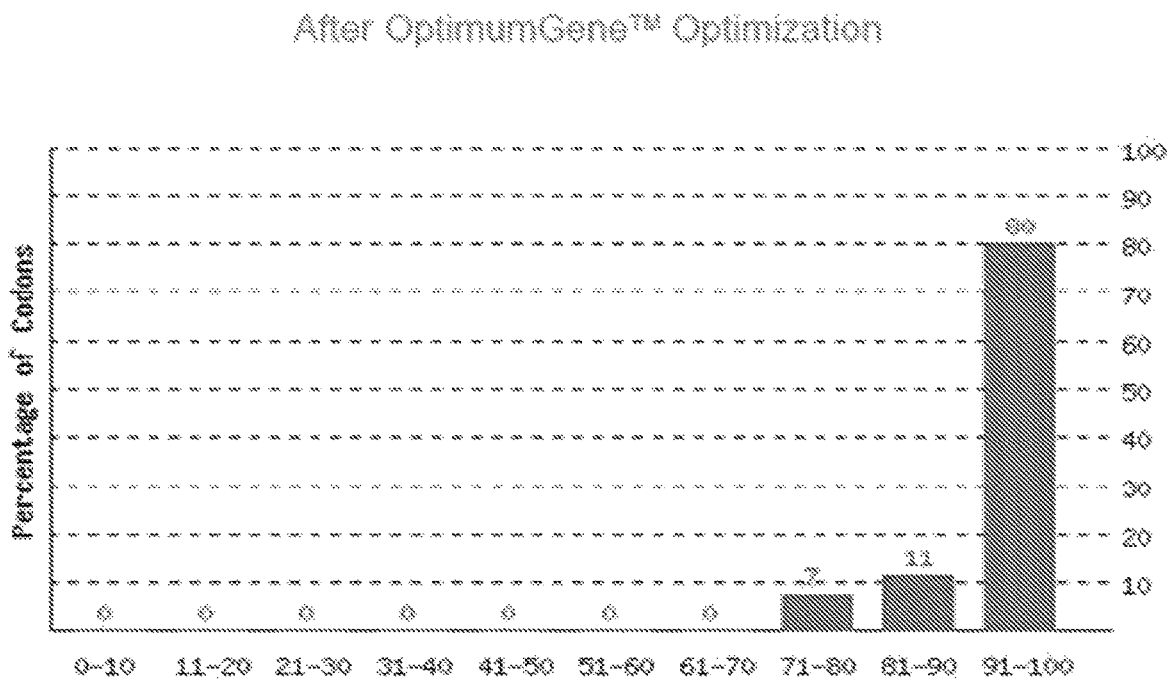
Figure 42C:
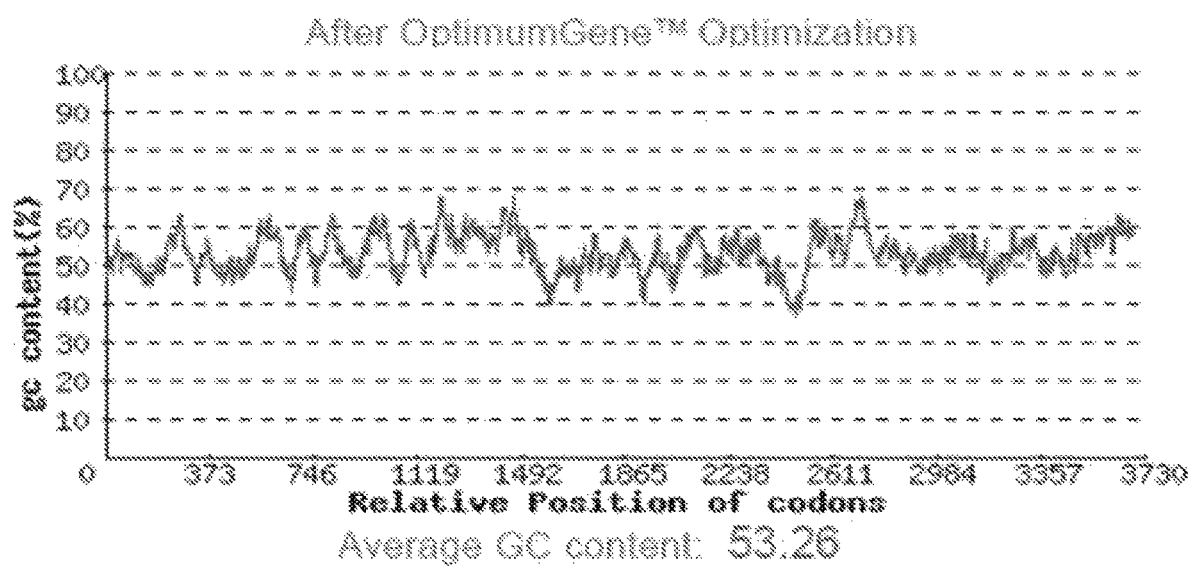
Figure 42F:
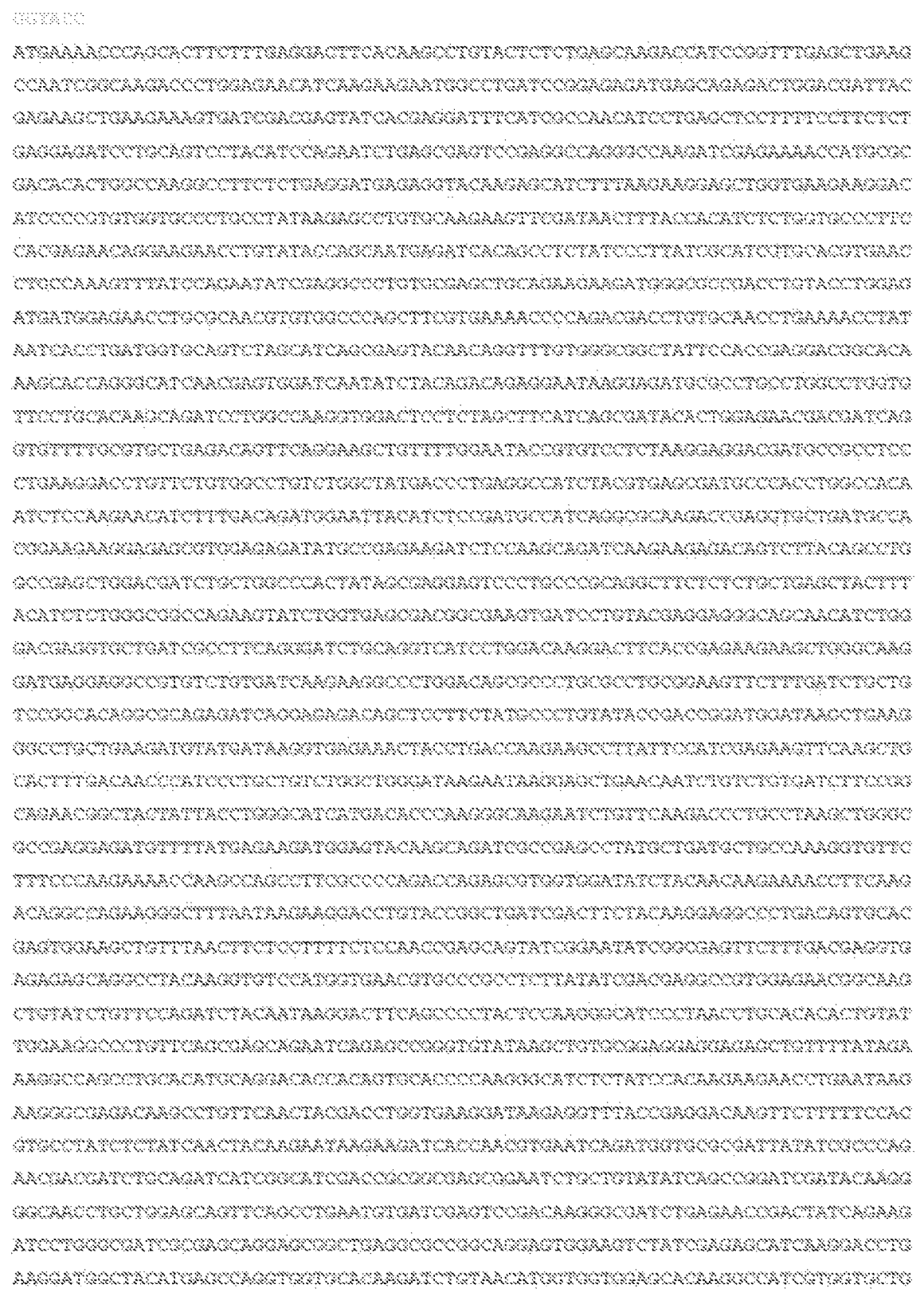
Figure 43I:
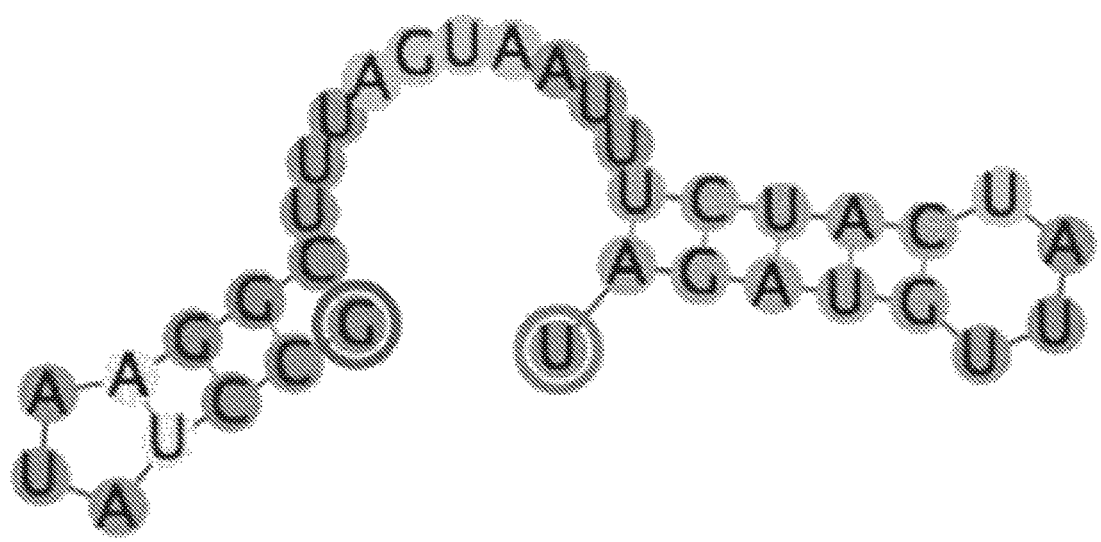

FIGS. 42A-42H shows the details of the human codon optimized sequence for *Porphyromonas macacae* Cpf1 having a gene length of 3888 nts (Ref #17 in FIG. 27). FIG. 42A: Codon Adaptation Index (CAI). The distribution of codon usage frequency along the length of the gene sequence. A CAI of 1.0 is considered to be perfect in the desired expression organism, and a CAI of >0.8 is regarded as good, in terms of high gene expression level. FIG. 42B: Frequency of Optimal Codons (FOP). The percentage distribution of codons in computed codon quality groups. The value of 100 is set for the codon with the highest usage frequency for a given amino acid in the desired expression organism. FIG. 42C: GC Content Adjustment. The ideal percentage range of GC content is between 30-70%. Peaks of % GC content in a 60 bp window have been removed. FIG. 79D: Restriction Enzymes and CIS-Acting Elements. FIG. 42E: Remove Repeat Sequences. FIG. 42F-G: Optimized Sequence (Optimized Sequence Length: 3888, GC % 53.26) (SEQ ID NO: 461). FIG. 42H: Protein Sequence (SEQ ID NO: 462).

FIG. 43A-43I shows direct repeat (DR) sequences for each ortholog (refer to numbering Ref #3-17 in FIG. 27) and their predicted fold structure. SEQ ID NOS 463-496, respectively, are disclosed in order of appearance.

FIG. 44 shows cleavage of a PCR amplicon of the human Emx1 locus. SEQ ID NOS 497-501, respectively, are disclosed in order of appearance.

Figure 45A:
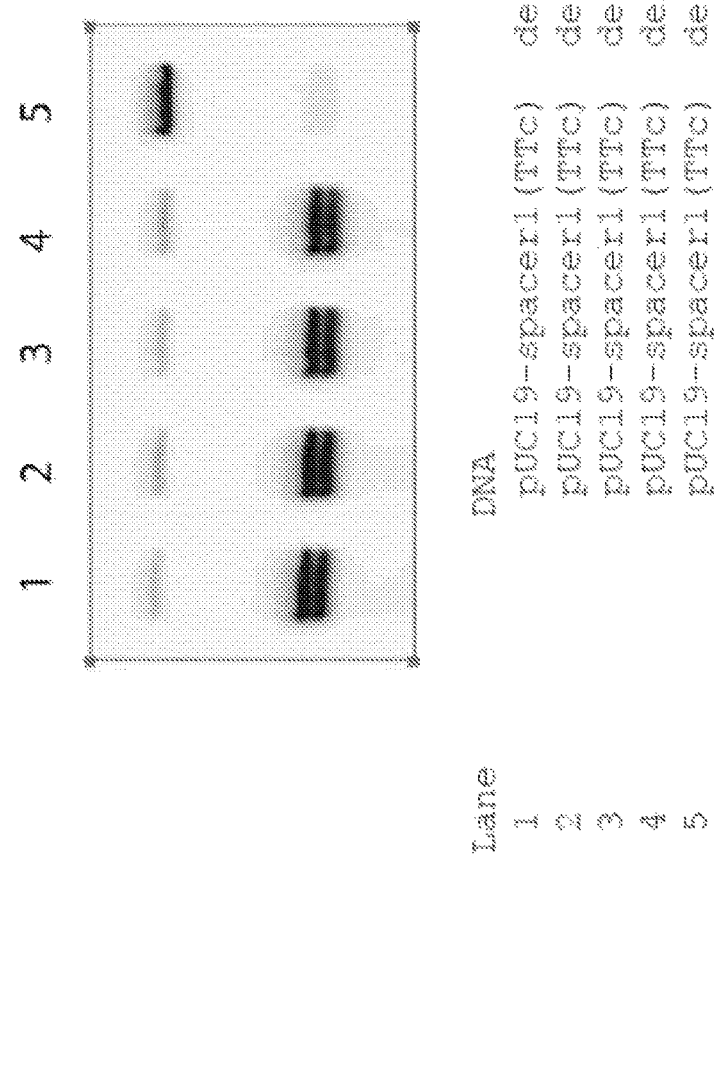
Figure 45B:
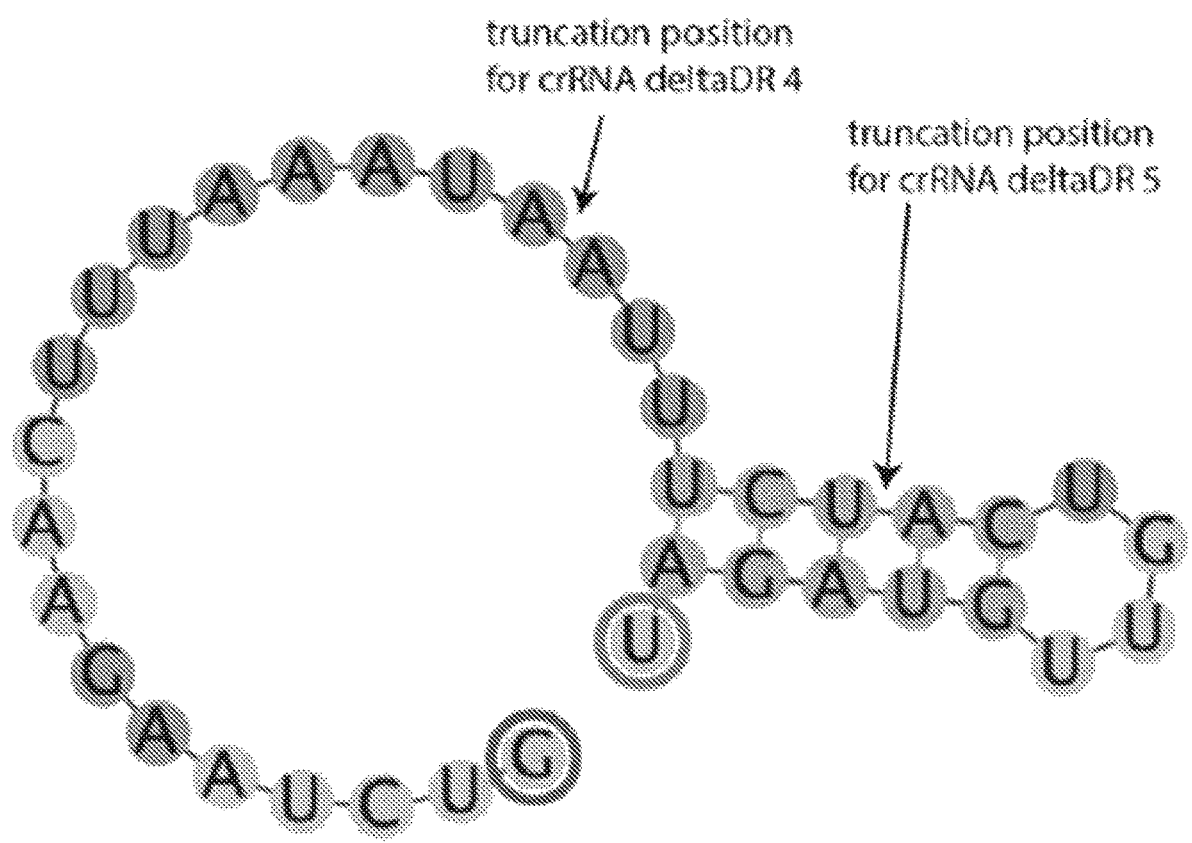

FIG. 45A-45B shows the effect of truncation in 5' DR on cleavage Activity. (A) shows a gel in which cleavage results with 5 DR truncations is indicated. (B) shows a diagram in which crDNA deltaDR5 disrupted the stem loop at the 5' end. This indicates that the stemloop at the 5' end is essential for cleavage activity. SEQ ID NOS 502-507, respectively, are disclosed in order of appearance.

Figure 46:
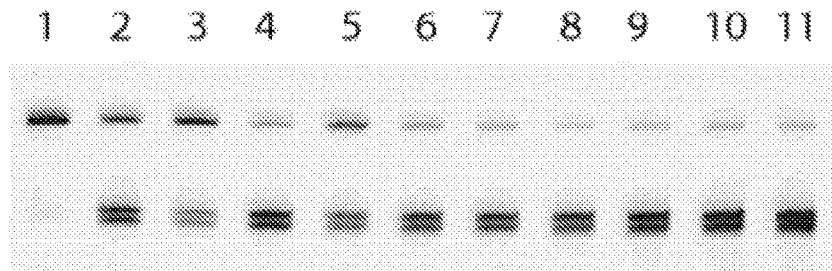

FIG. 46 shows the effect of crRNA-DNA target mismatch on cleavage efficiency. SEQ ID NOS 508-518, respectively, are disclosed in order of appearance.

FIG. 47 shows the cleavage of DNA using purified *Francisella* and *Prevotella* Cpf1. SEQ ID NO: 519 is disclosed.

Figure 48A:
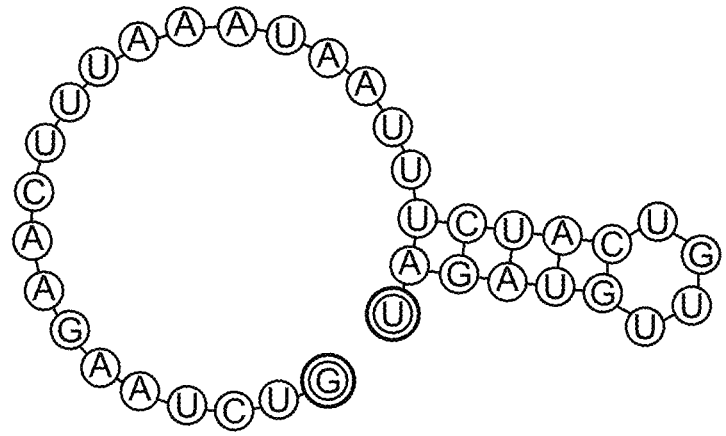
Figure 48B:
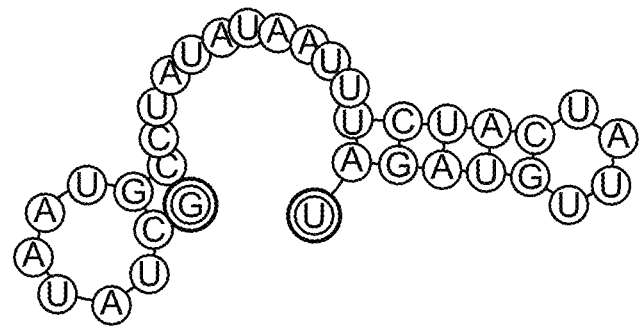

FIG. 48A-48B show diagrams of DR secondary structures. (A) FnCpf1 DR secondary structure (SEQ ID NO: 520) (stem loop highlighted). (B) PaCpf1 DR secondary structure (SEQ ID NO: 521) (stem loop highlighted, identical except for a single base difference in the loop region).

Figure 49:
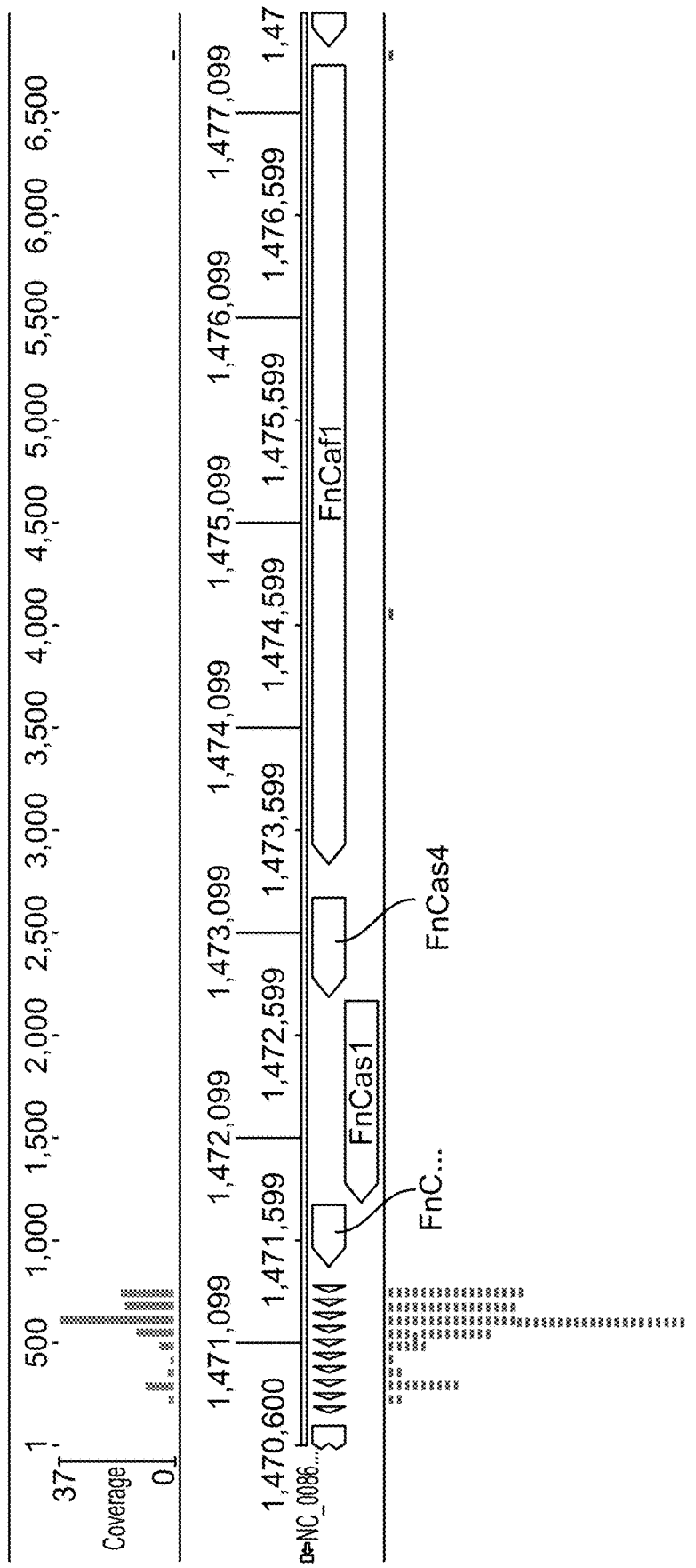

FIG. 49 shows a further depiction of the RNAseq analysis of the FnCp1 locus.

Figure 50A:
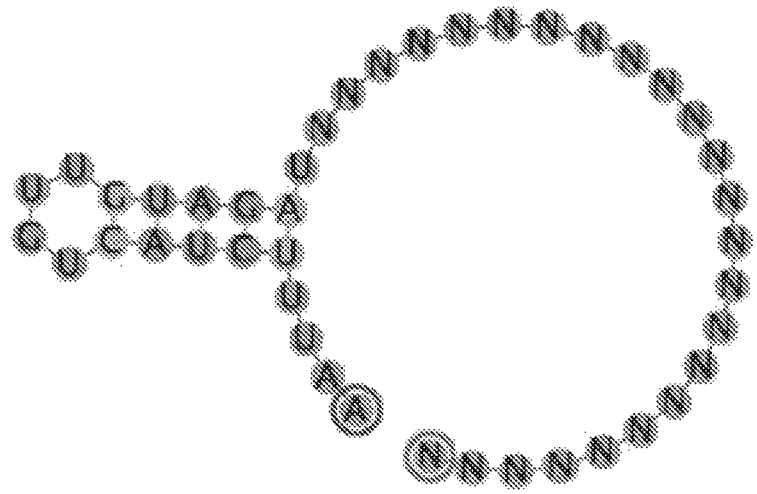
Figure 50B:
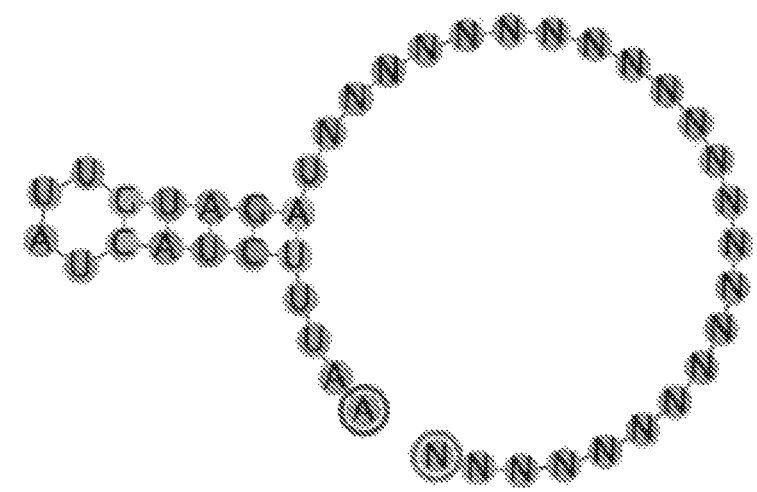

FIG. 50A-50B show schematics of mature crRNA sequences. (A) Mature crRNA sequences for FnCpf1. (B) Mature crRNA sequences for PaCpf1. SEQ ID NOS 522-525, respectively, are disclosed in order of appearance.

Figure 51:
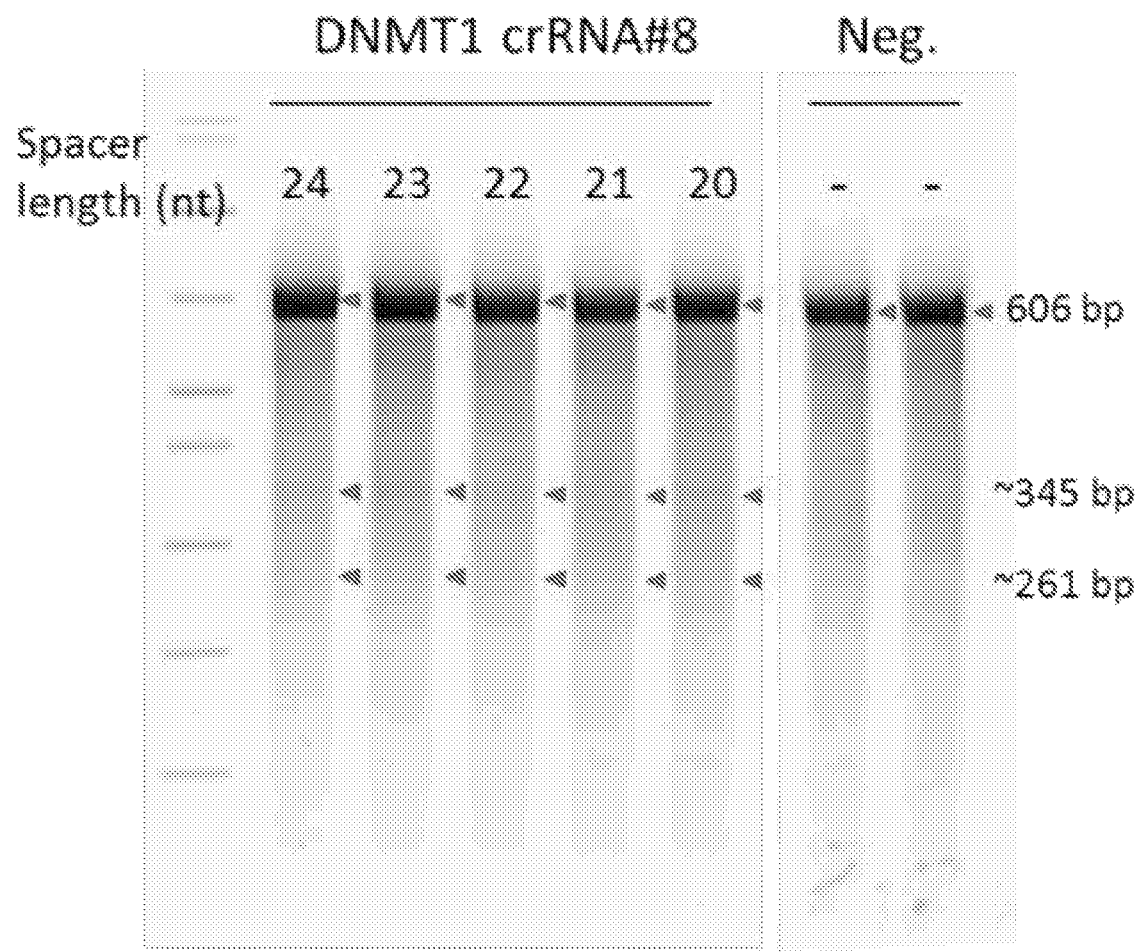

FIG. 51 shows cleavage of DNA using human codon optimized *Francisella novicida* FnCpf1. The top band corresponds to un-cleaved full length fragment (606 bp). Expected cleavage product sizes of ~345 bp and ~261 bp are indicated by triangles.

Figure 52:
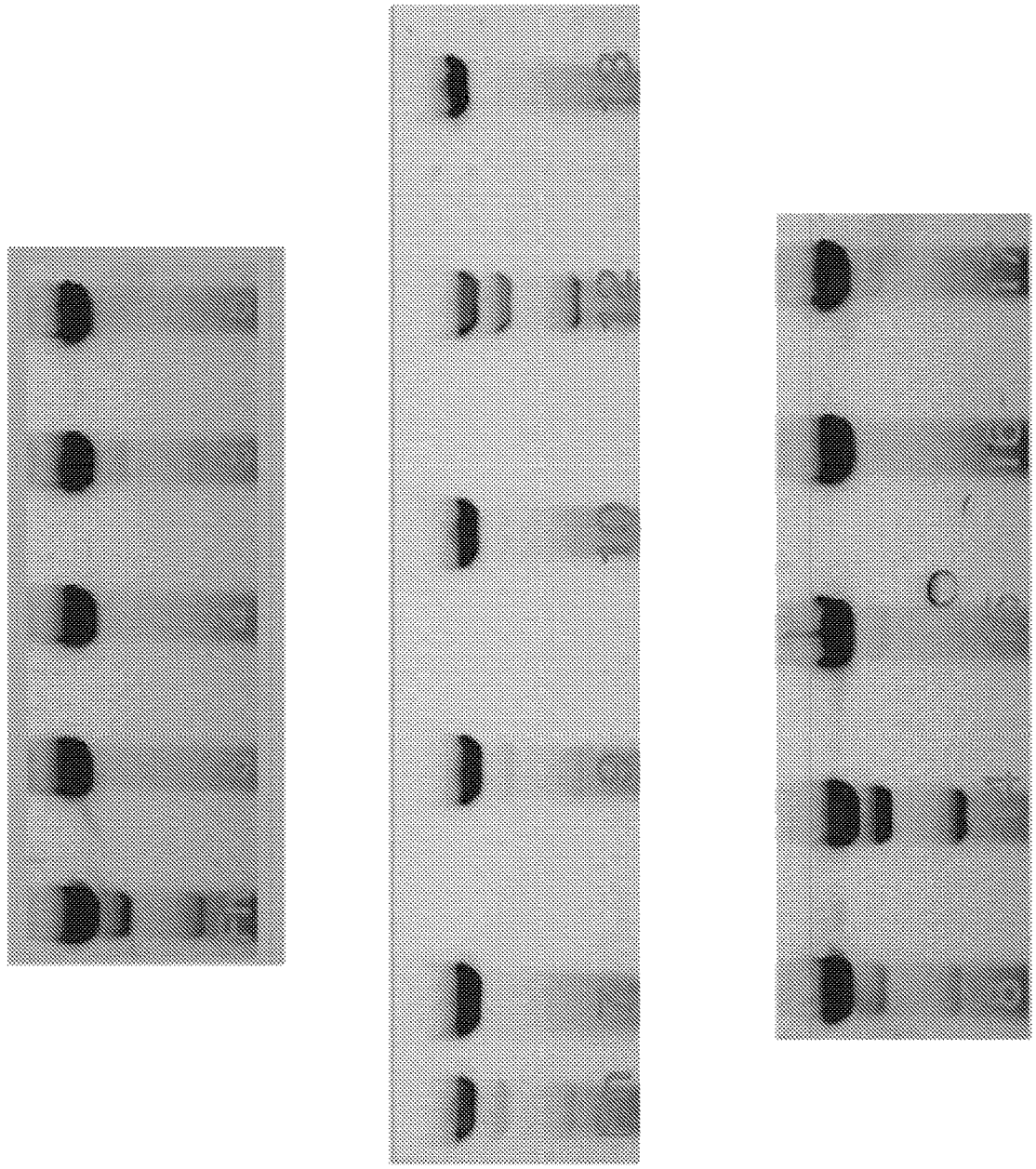

FIG. 52 shows in vitro ortholog assay demonstrating cleavage by Cpf1 orthologs.

Figure 53A:
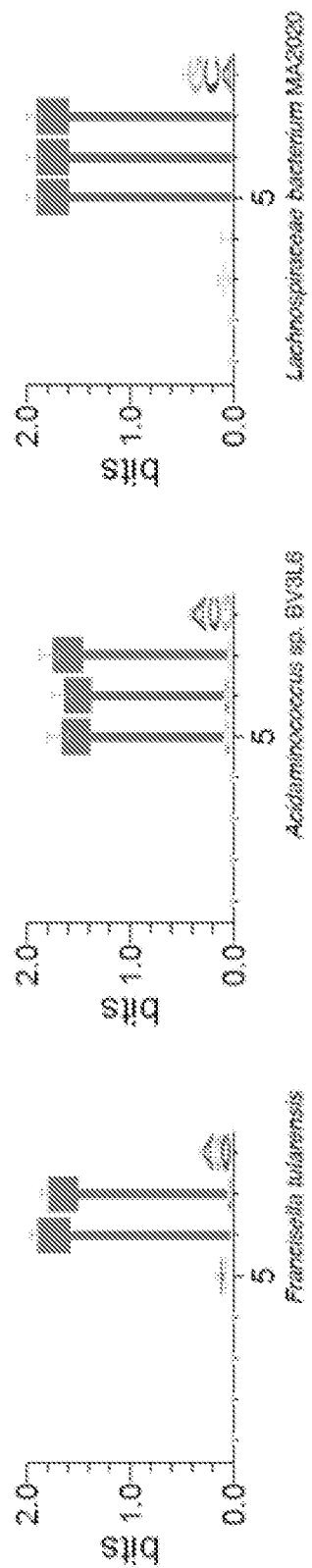
Figure 53B:
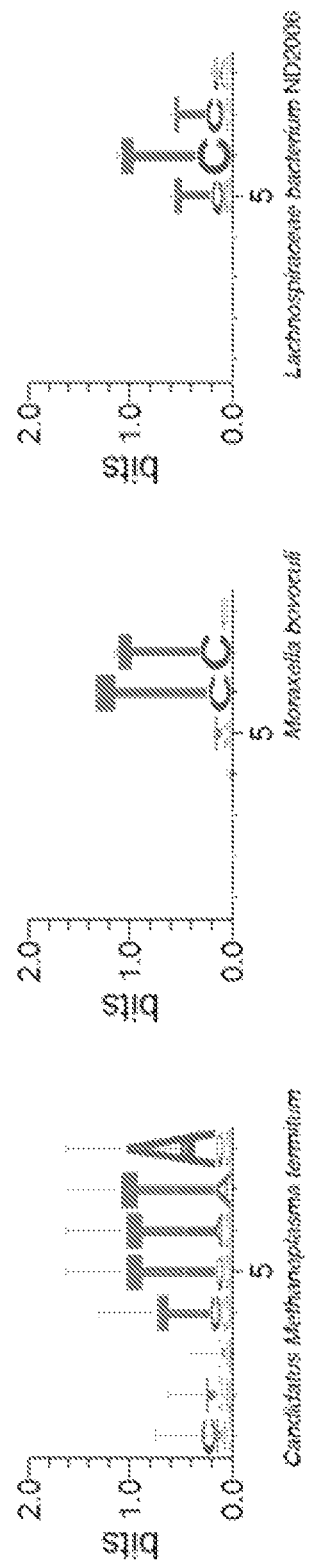

FIGS. 53A-53C show computationally derived PAMs from the in vitro cutting assay.

Figure 54:
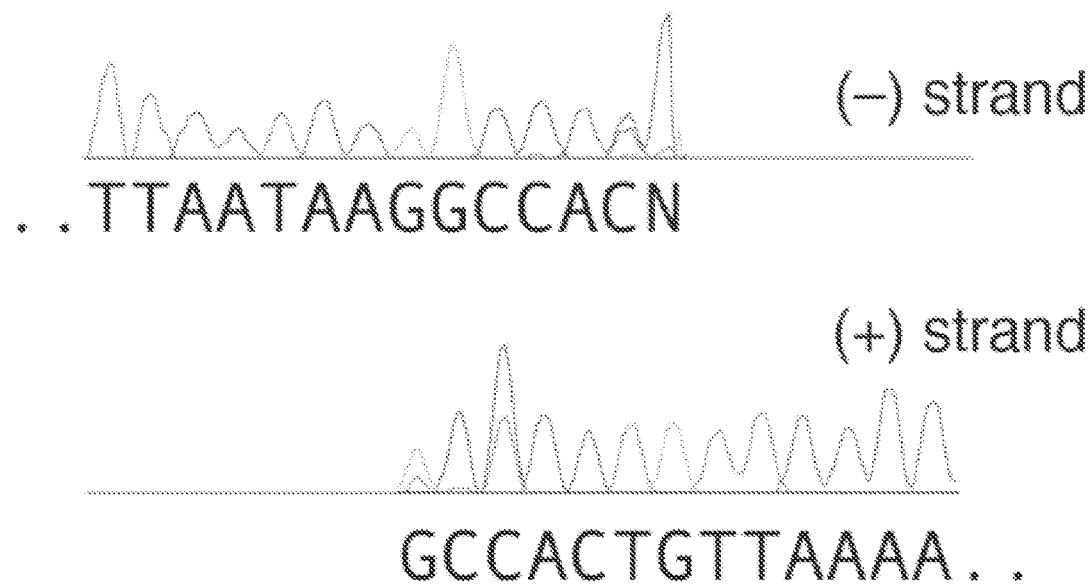

FIG. 54 shows Cpf1 cutting in a staggered fashion with 5' overhangs. SEQ ID NOS 526-528, respectively, are disclosed in order of appearance.

Figure 55:
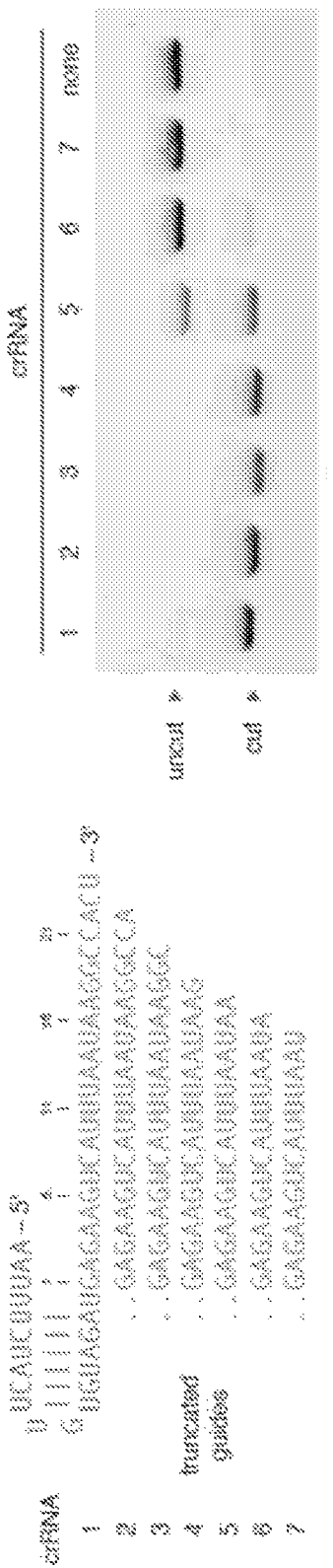

FIG. 55 shows effect of spacer length on cutting. SEQ ID NOS 529-535, respectively, are disclosed in order of appearance.

Figure 56:
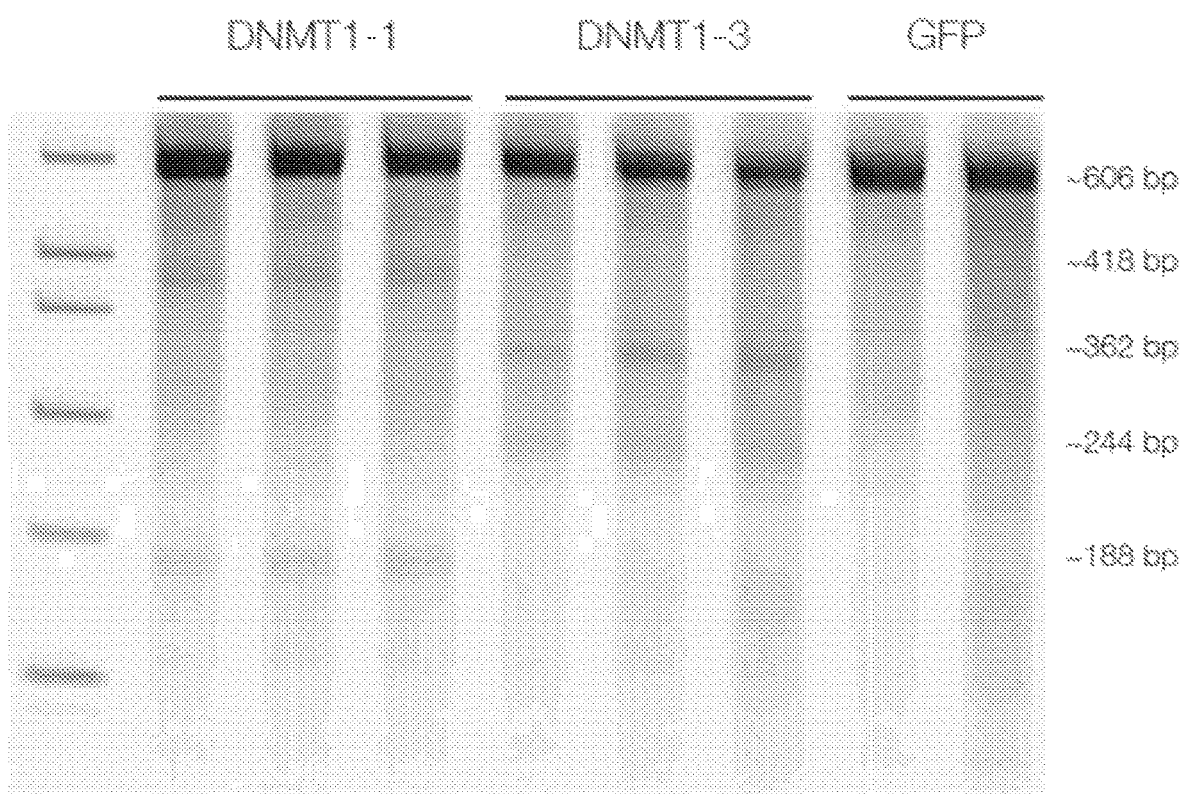

FIG. 56 shows SURVEYOR data for FnCpf1 mediated indels in HEK293T cells.

Figure 57A:
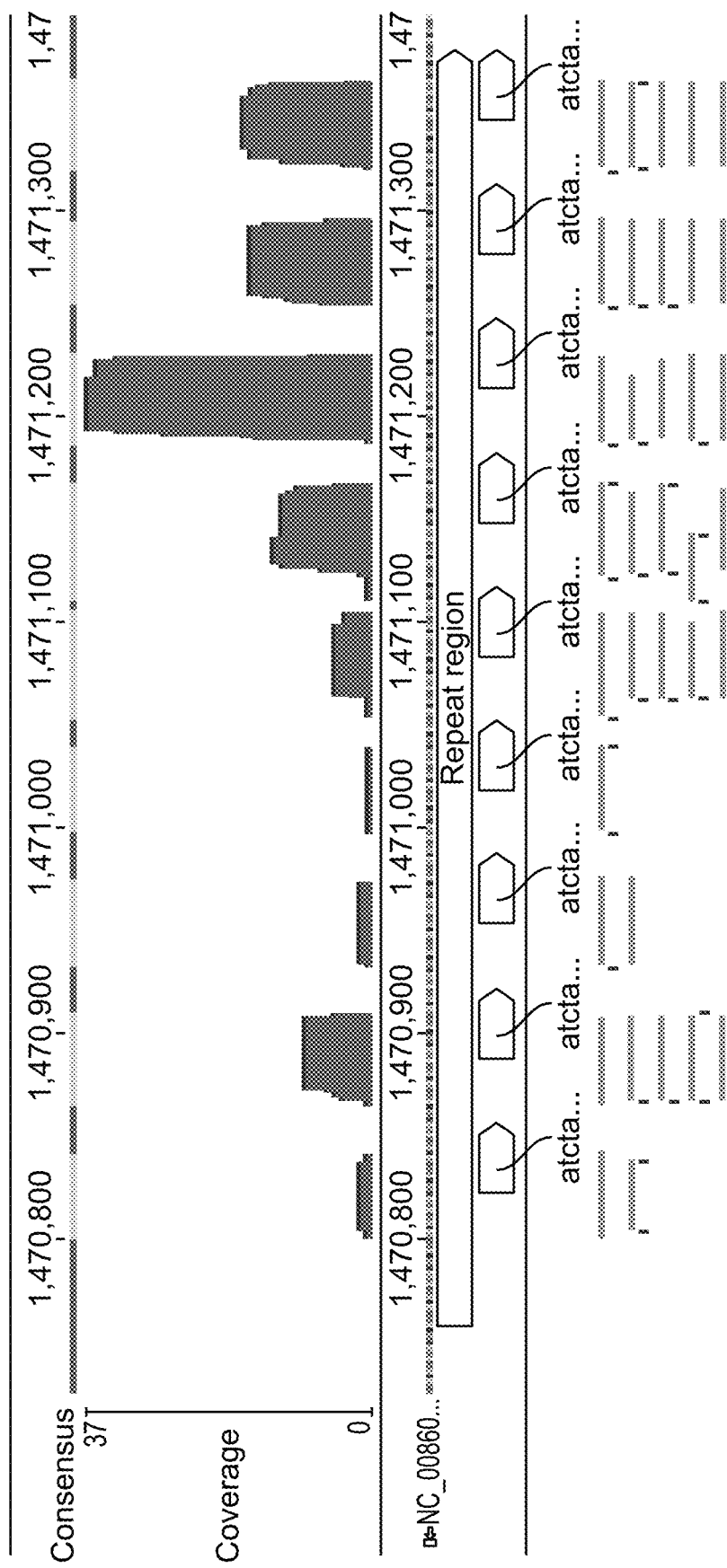
Figure 57B:
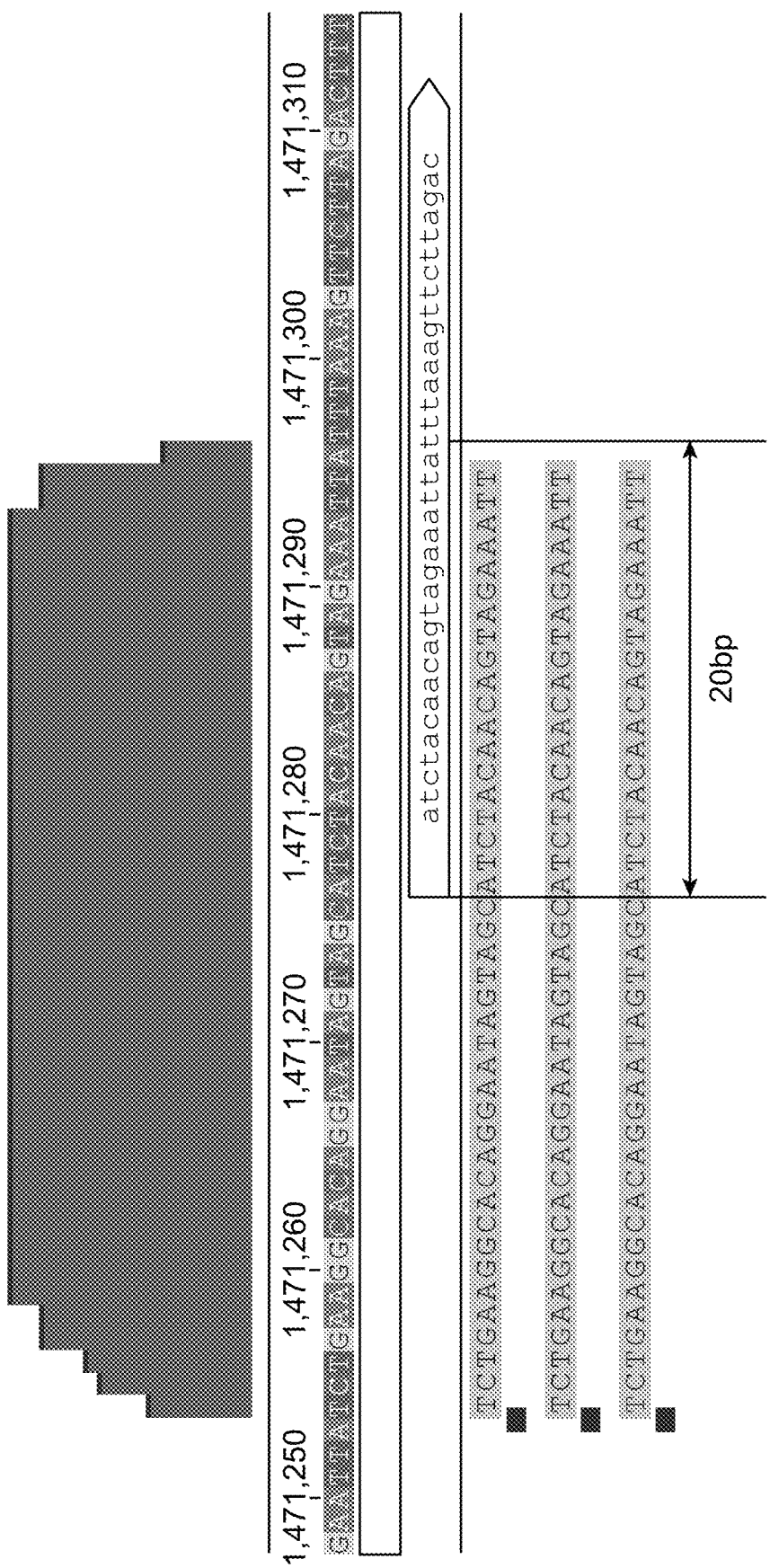
Figure 57C:
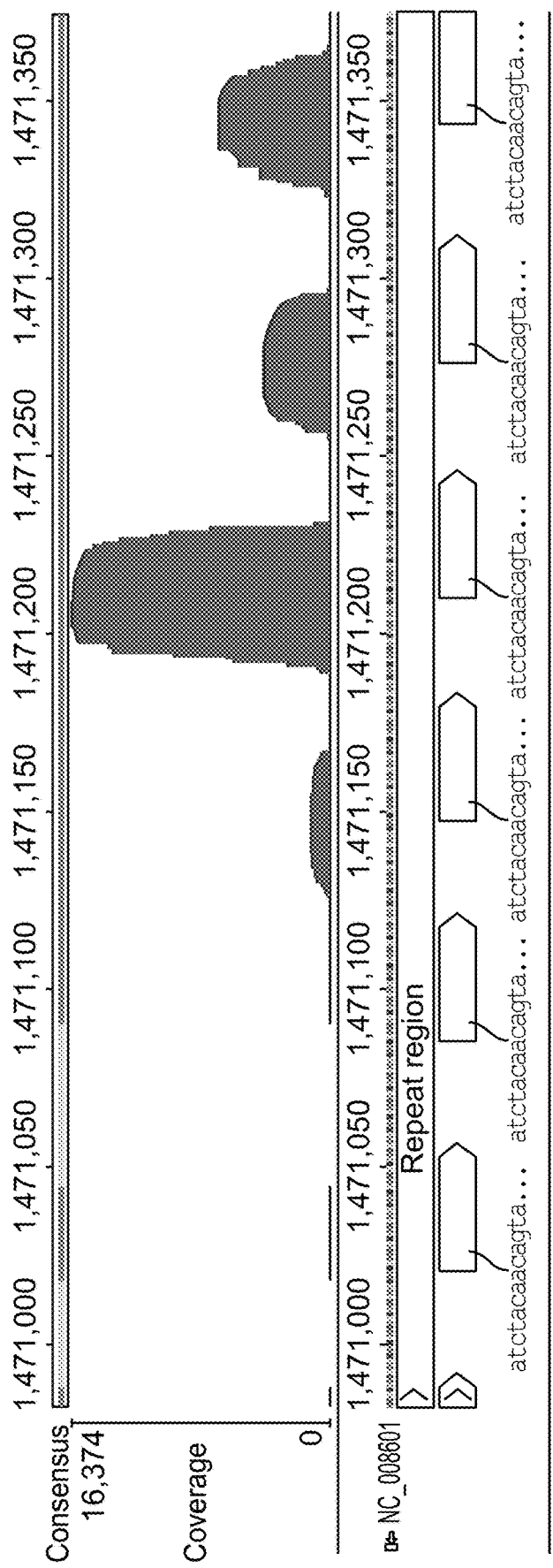
Figure 57D:
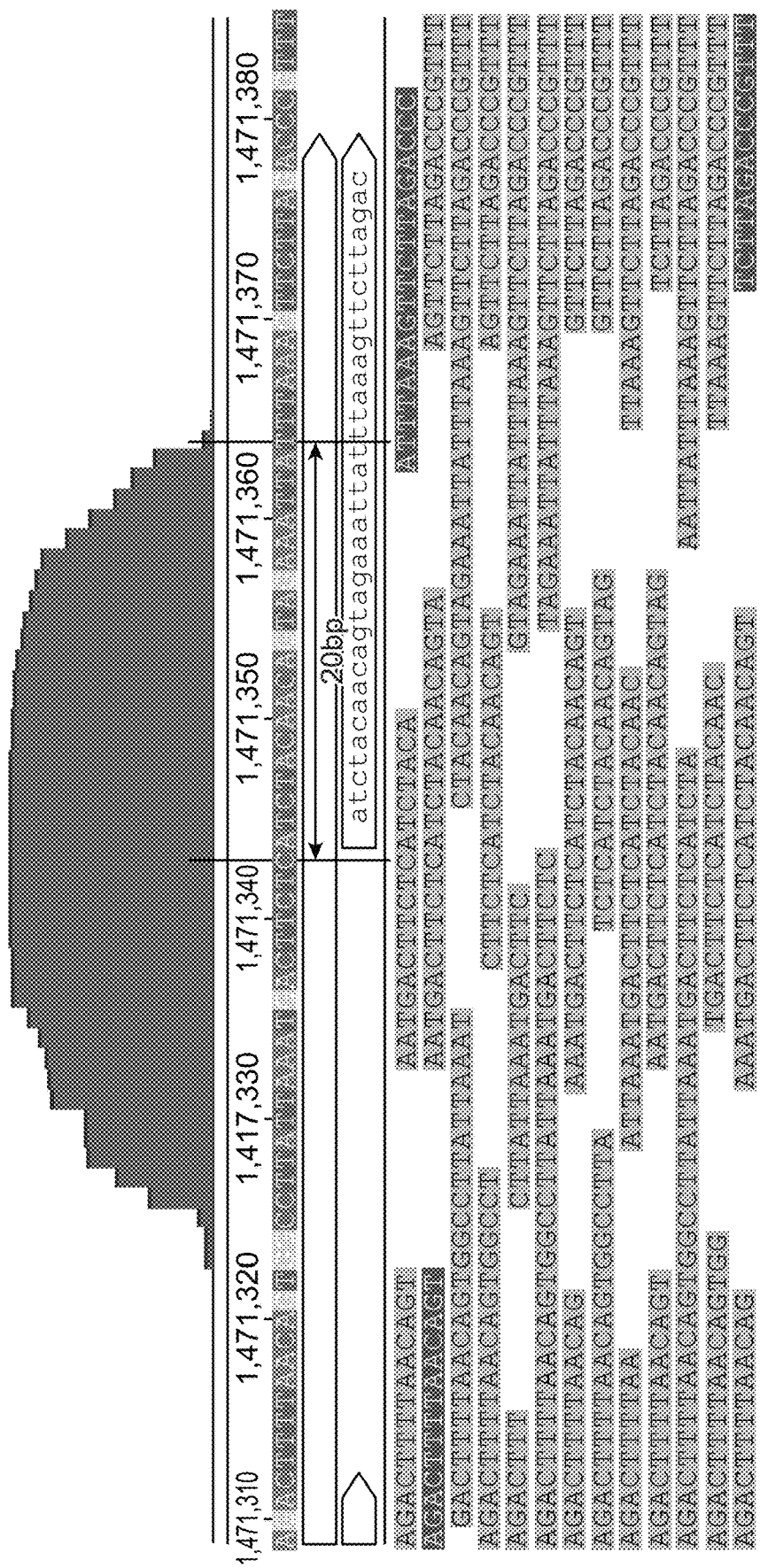
Figure 57E:
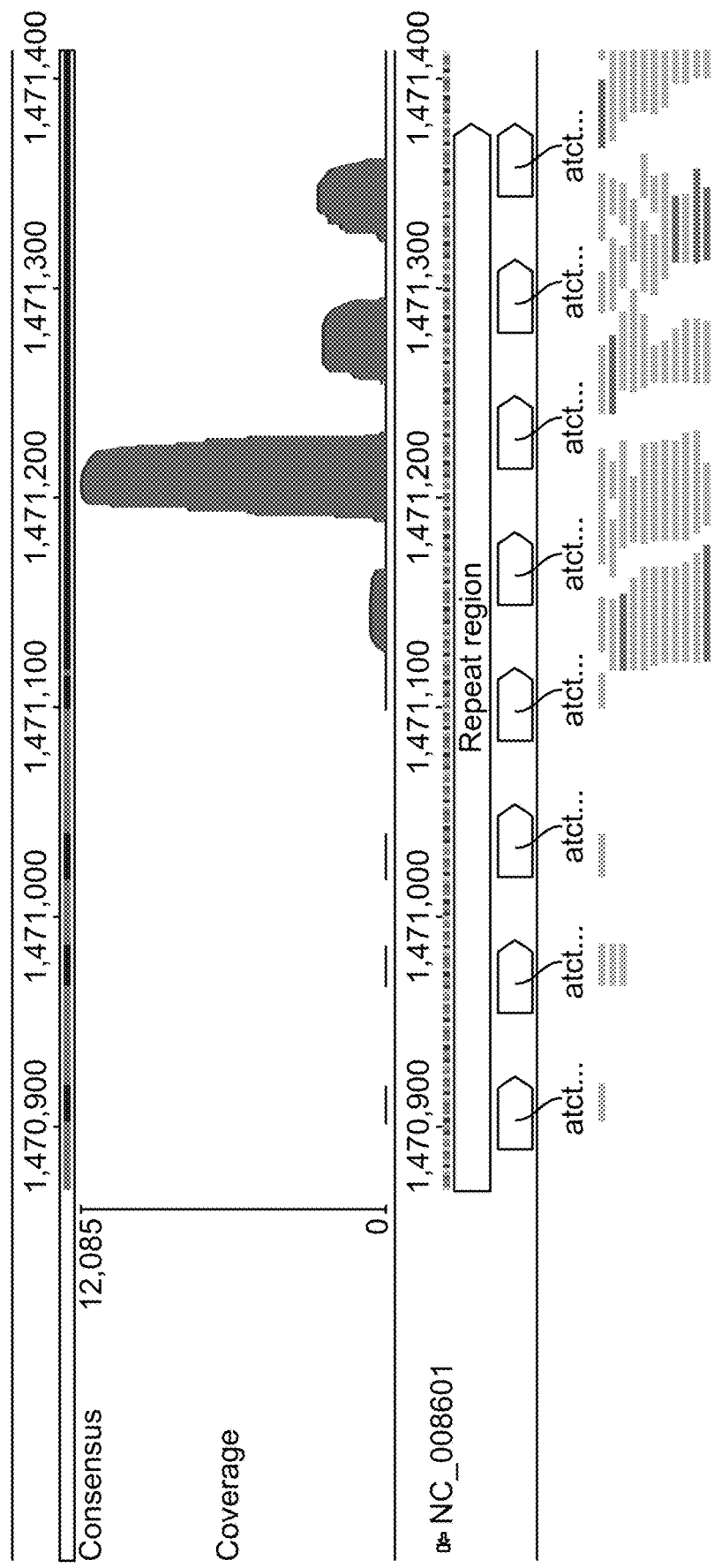
Figure 57F:
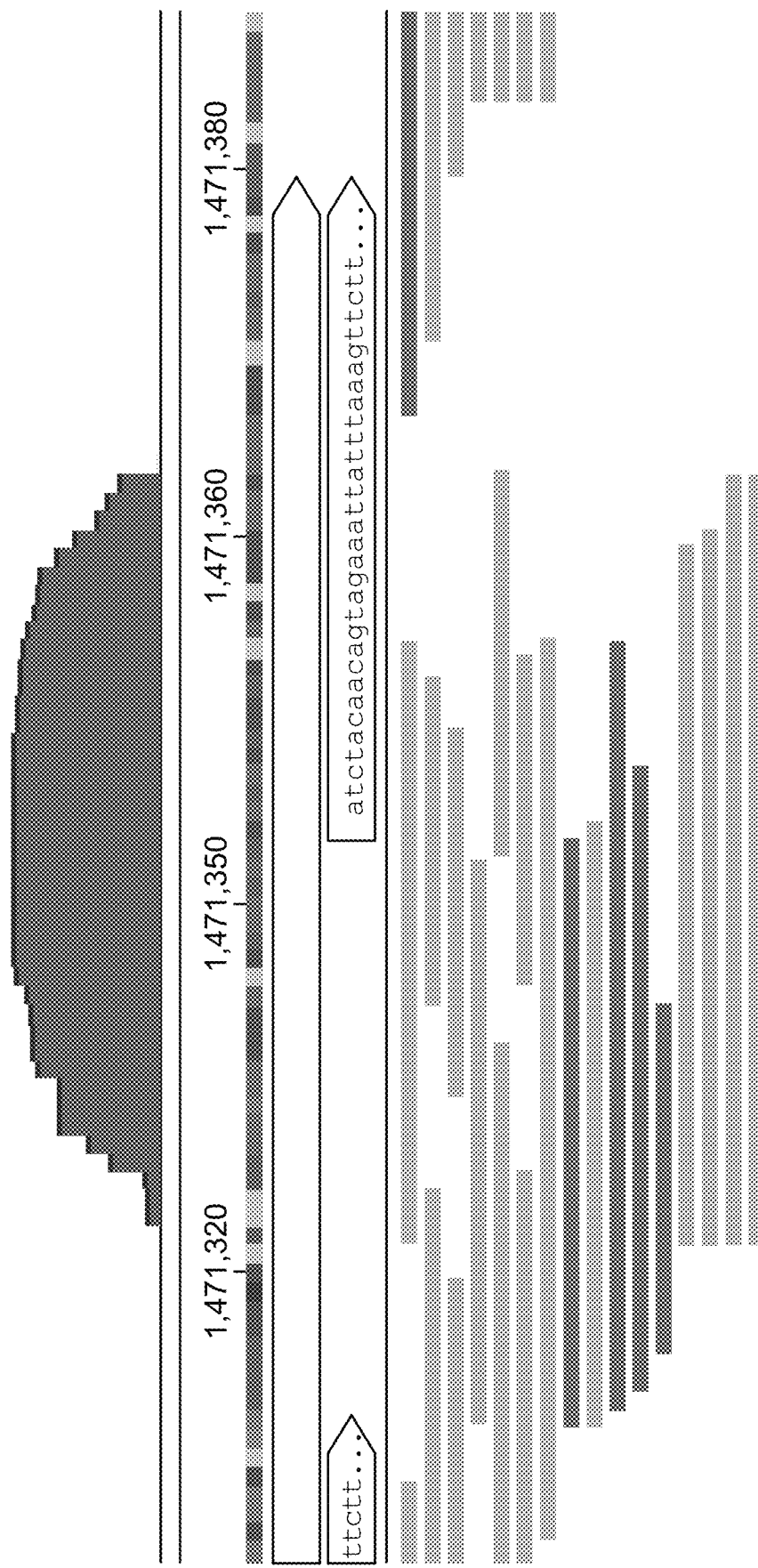

FIGS. 57A-57F show the processing of transcripts when sections of the FnCpf1 locus are deleted as compared to the processing of transcripts in a wild type FnCpf1 locus. FIGS. 57B, 57D and 57F zoom in on the processed spacer. SEQ ID NOS 536-584, respectively, are disclosed in order of appearance.

Figure 58A:
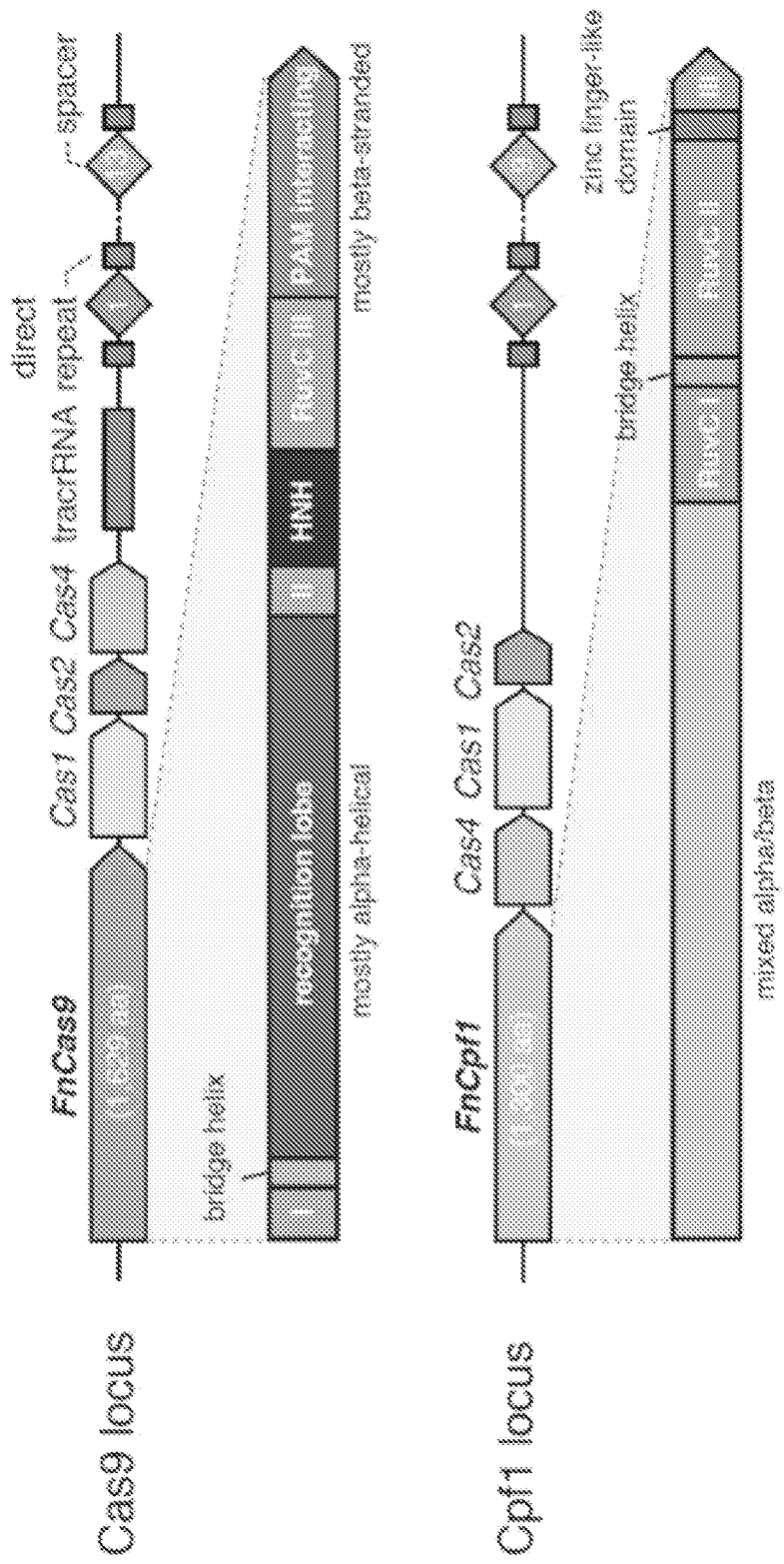
Figure 58B:
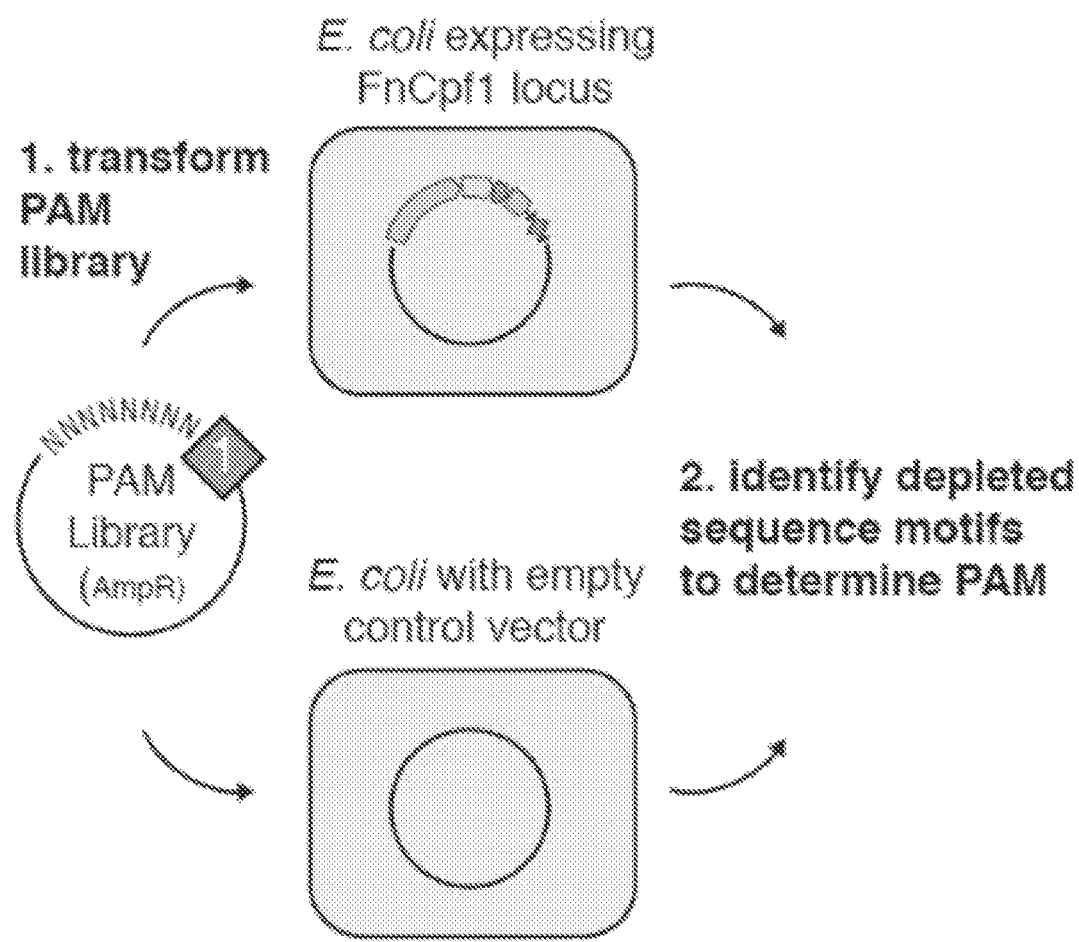
Figure 58C:
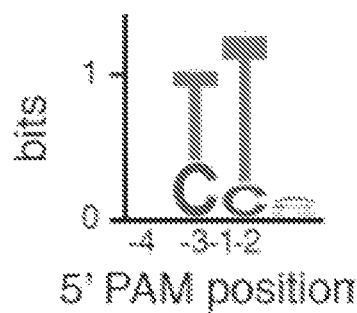
Figure 58D:
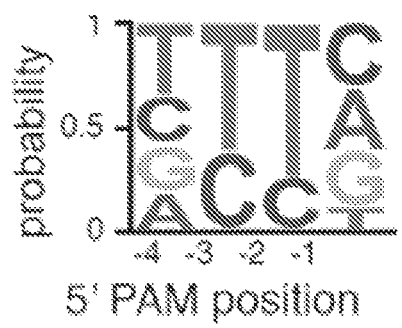
Figure 58E:
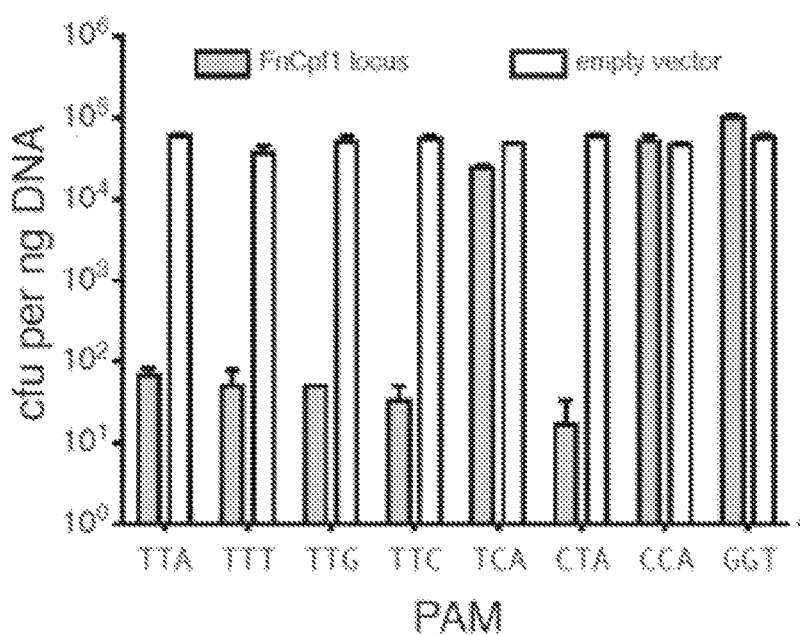

FIGS. 58A-58E show the *Francisella tularensis* subsp. *novicida* U112 Cpf1 CRISPR locus provides immunity against transformation of plasmids containing protospacers flanked by a 5'-TTN PAM. FIG. 58A show the organization of two CRISPR loci found in *Francisella tularensis* subsp. *novicida* U112 (NC_008601). The domain organization of FnCas9 and FnCpf1 are compared. FIG. 58B provide a schematic illustration of the plasmid depletion assay for discovering the PAM position and identity. Competent *E. coli* harboring either the heterologous FnCpf1 locus plasmid (pFnCpf1) or the empty vector control were transformed with a library of plasmids containing the matching protospacer flanked by randomized 5' or 3' PAM sequences and selected with antibiotic to deplete plasmids carrying successfully-targeted PAM. Plasmids from surviving colonies were extracted and sequenced to determine depleted PAM sequences. FIGS. 58C-58D show sequence logos for the FnCpf1 PAM as determined by the plasmid depletion assay. Letter height at position is determined by information content; error bars show 95% Bayesian confidence interval. FIG. 58E shows *E. coli* harboring pFnCpf1 demonstrate robust interference against plasmids carrying 5'-TTN PAMs (n=3, error bars represent mean f S.E.M.).

Figure 59A:
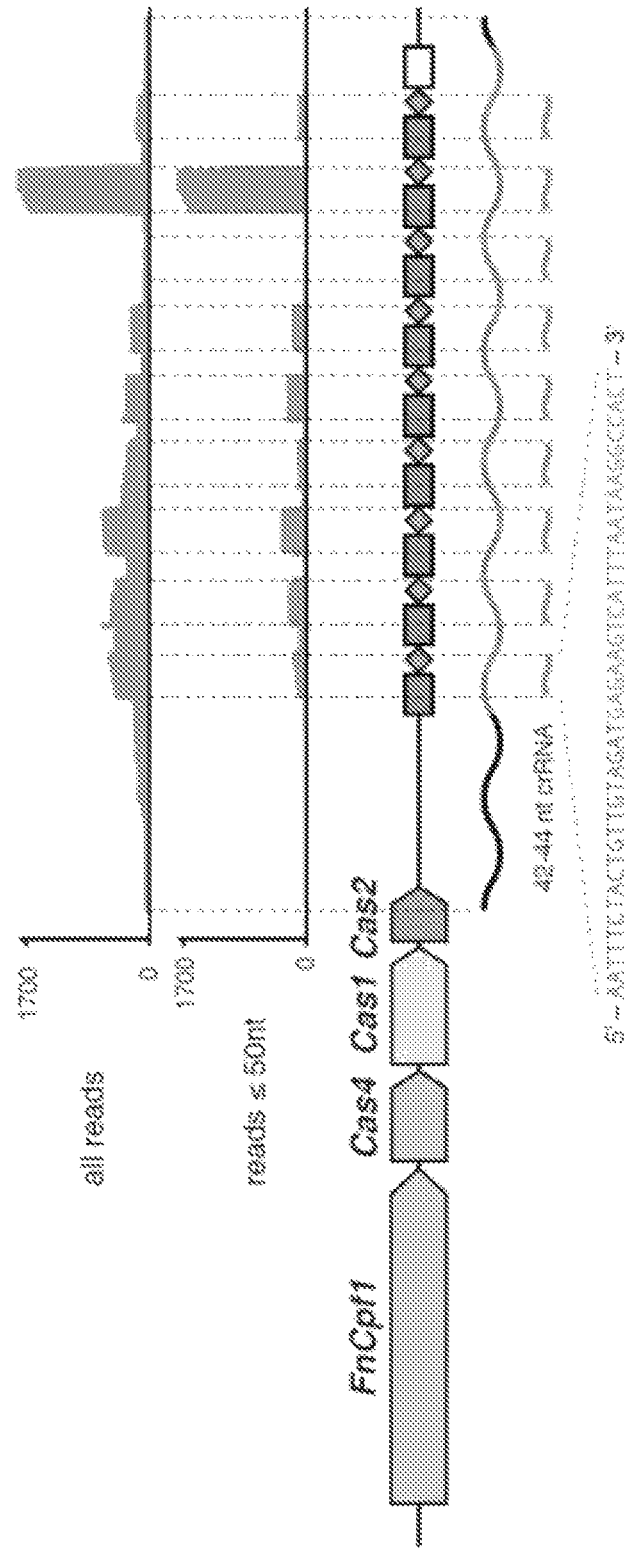
Figure 59B:
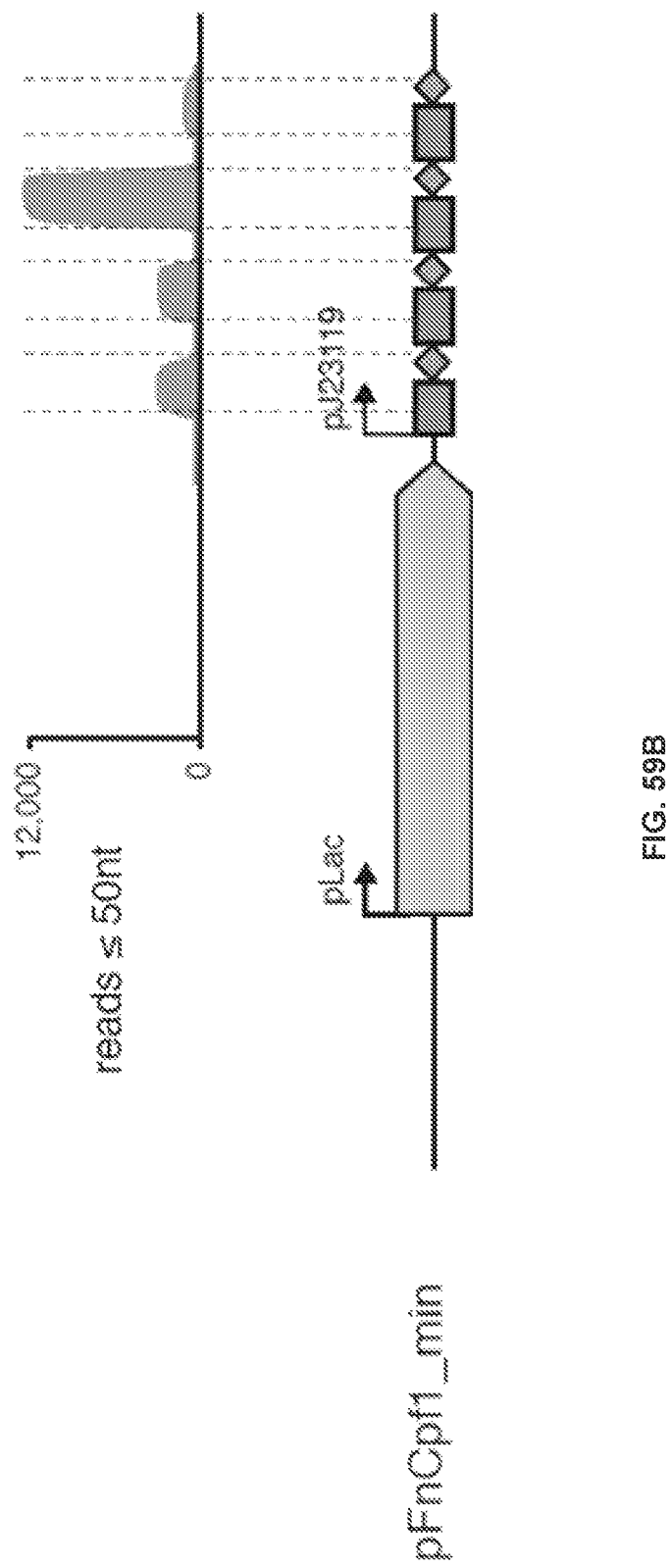

FIGS. 59A-59C shows heterologous expression of FnCpf1 and CRISPR array in *E. coli* is sufficient to mediate plasmid DNA interference and crRNA maturation. Small RNA-seq of *Francisella tularensis* subsp. *novicida* U112 (FIG. 59A) reveals transcription and processing of the FnCpf1 CRISPR array. The mature crRNA begins with a 19 nt partial direct repeat followed by 23-25 nt of spacer sequence. Small RNA-seq of *E. coli* transformed with a plasmid carrying synthetic promoter-driven FnCpf1 and CRISPR array (FIG. 59B) shows crRNA processing independent of Cas genes and other sequence elements in the FnCpf1 locus. FIG. 59C depicts *E. coli* harboring different truncations of the FnCpf1 CRISPR locus and shows that only FnCpf1 and the CRISPR array are required for plasmid DNA interference (n=3, error bars show mean f S.E.M.). SEQ ID NO: 585 is disclosed.

Figure 60A:
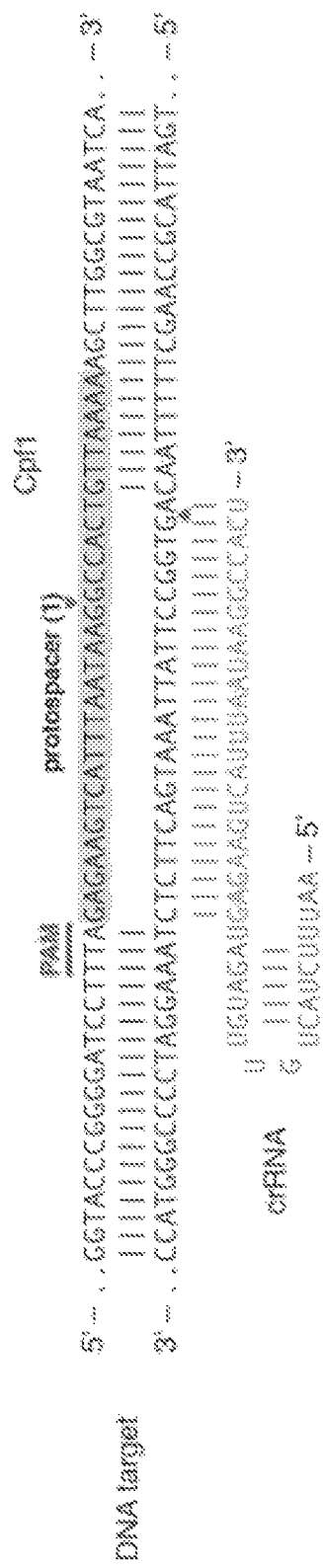
Figure 60B:
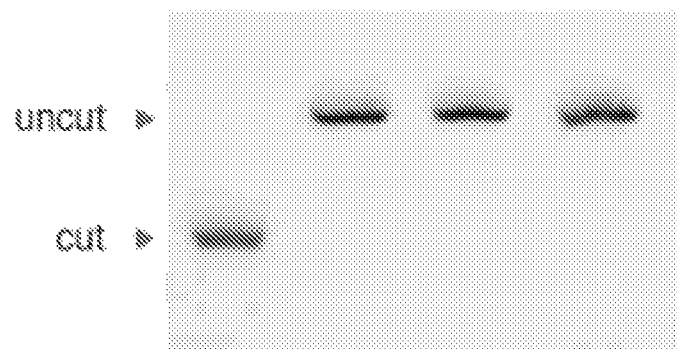
Figure 60C:
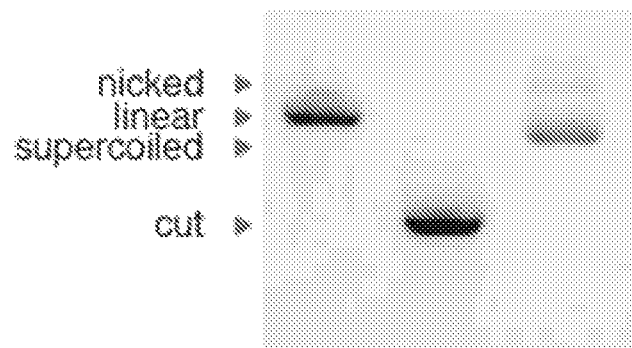
Figure 60D:
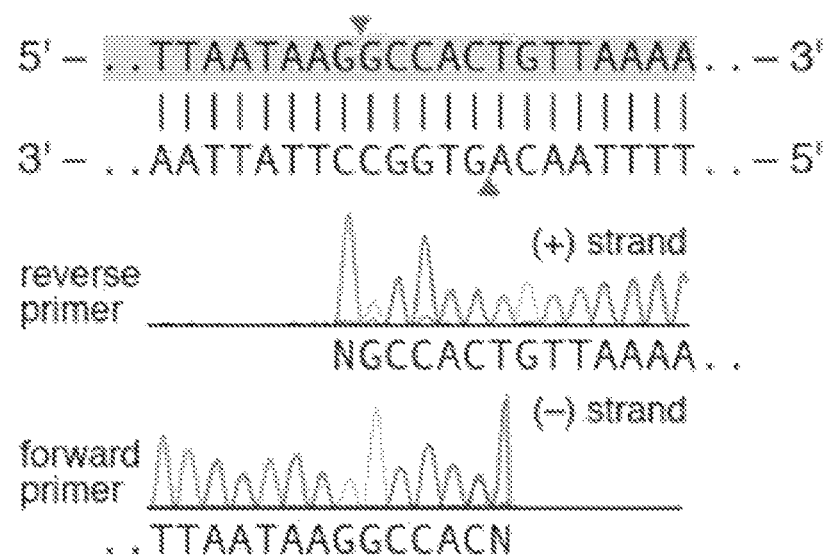
Figure 60E:
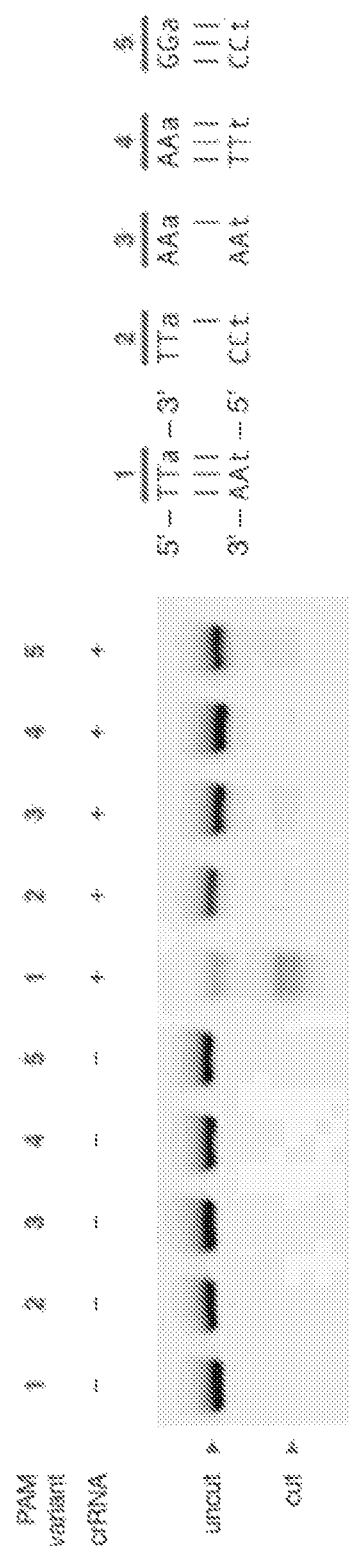

FIGS. 60A-60E shows FnCpf1 is targeted by crRNA to cleave DNA in vitro. FIG. 60A is a schematic of the FnCpf1 crRNA-DNA targeting complex. Cleavage sites are indicated by red arrows (SEQ ID NOS 586 and 587, respectively, disclosed in order of appearance). FnCpf1 and crRNA alone mediated RNA-guided cleavage of target DNA in a crRNA- and $Mg^{2+}$-dependent manner (FIG. 60B). FIG. 60C shows FnCpf1 cleaves both linear and supercoiled DNA. FIG. 60D shows Sanger sequencing traces from FnCpf1-digested target show staggered overhangs (SEQ ID NOS 588-590, respectively, disclosed in order of appearance). The non-templated addition of an additional adenine, denoted as N, is an artifact of the polymerase used in sequencing. Reverse primer read represented as reverse complement to aid visualization. FIG. 60E shows cleavage is dependent on base-pairing at the 5' PAM. FnCpf1 can only recognize the PAM in correctly Watson-Crick paired DNA.

Figure 61A:
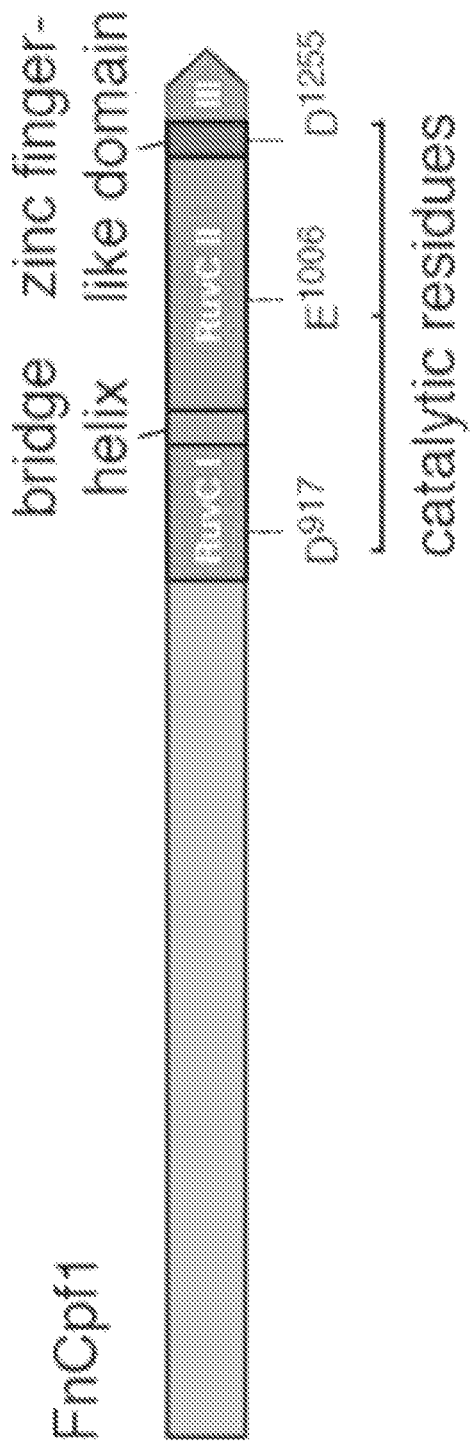
Figure 61B:
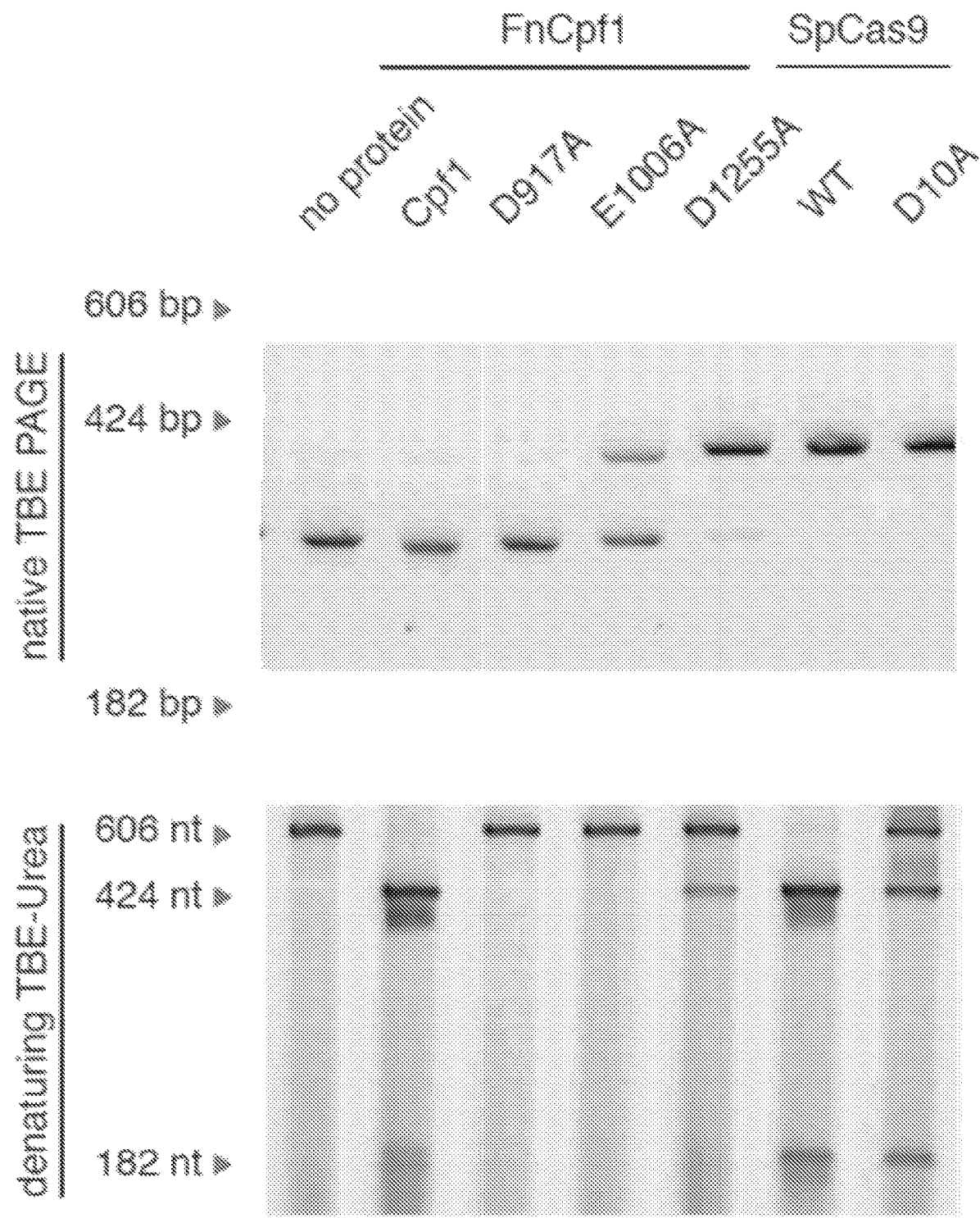

FIGS. 61A-61B shows catalytic residues in the C-terminal RuvC domain of FnCpf1 are necessary for DNA cleavage. FIG. 61A shows the domain structure of FnCpf1 with RuvC catalytic residues highlighted. The catalytic residues were identified based on sequence homology to *Thermus thermophilus* RuvC (PDB ID: 4EP5). FIG. 61B depicts a native TBE PAGE gel showing that mutation of the RuvC catalytic residues of FnCpf1 (D917A and E1006A) and mutation of the RuvC (D10A) catalytic residue of SpCas9 prevents double stranded DNA cleavage. Denaturing TBE-Urea PAGE gel showing that mutation of the RuvC catalytic residues of FnCpf1 (D917A and E1006A) prevents DNA nicking activity, whereas mutation of the RuvC (D10A) catalytic residue of SpCas9 results in nicking of the target site.

Figure 62A:
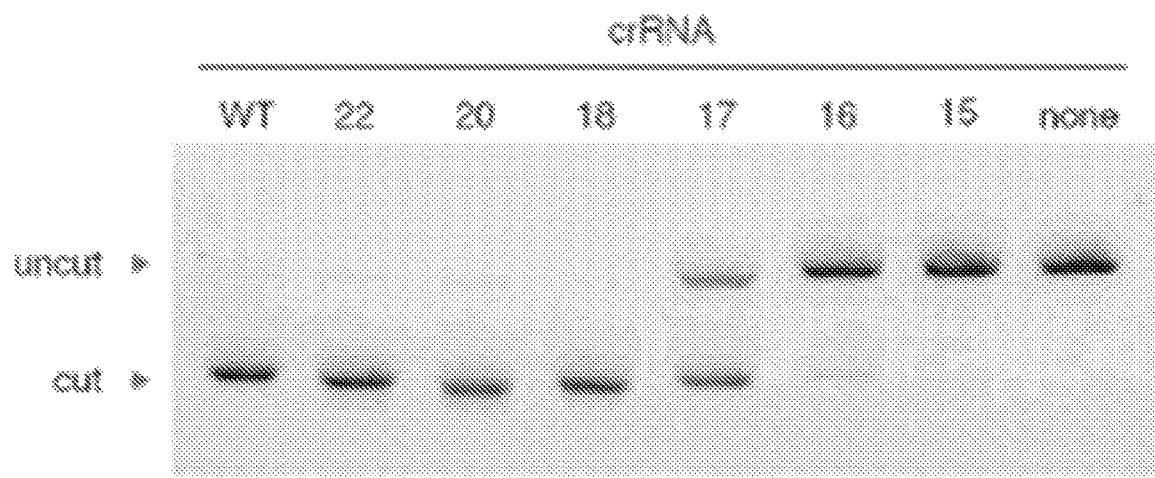
Figure 62B:
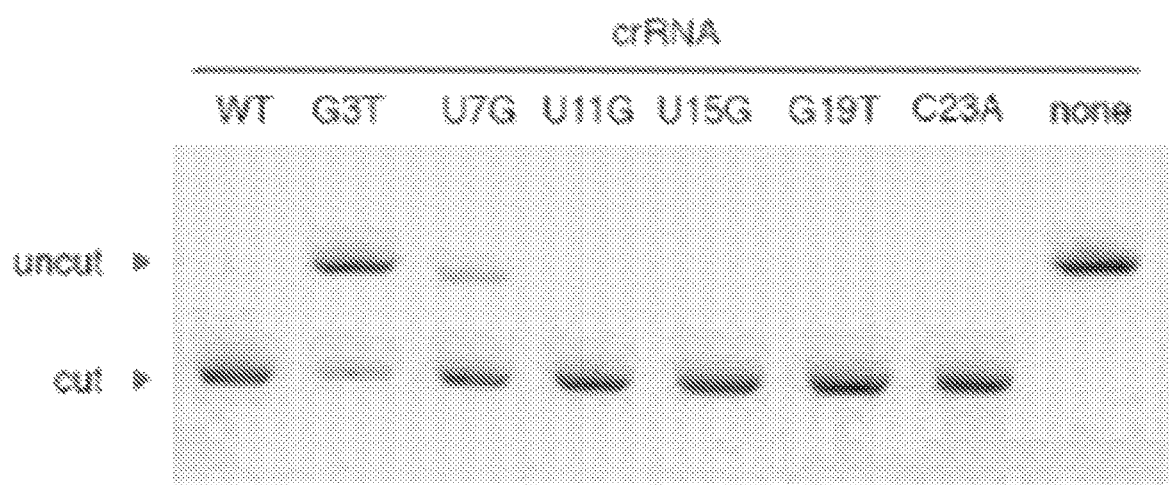
Figure 62C:
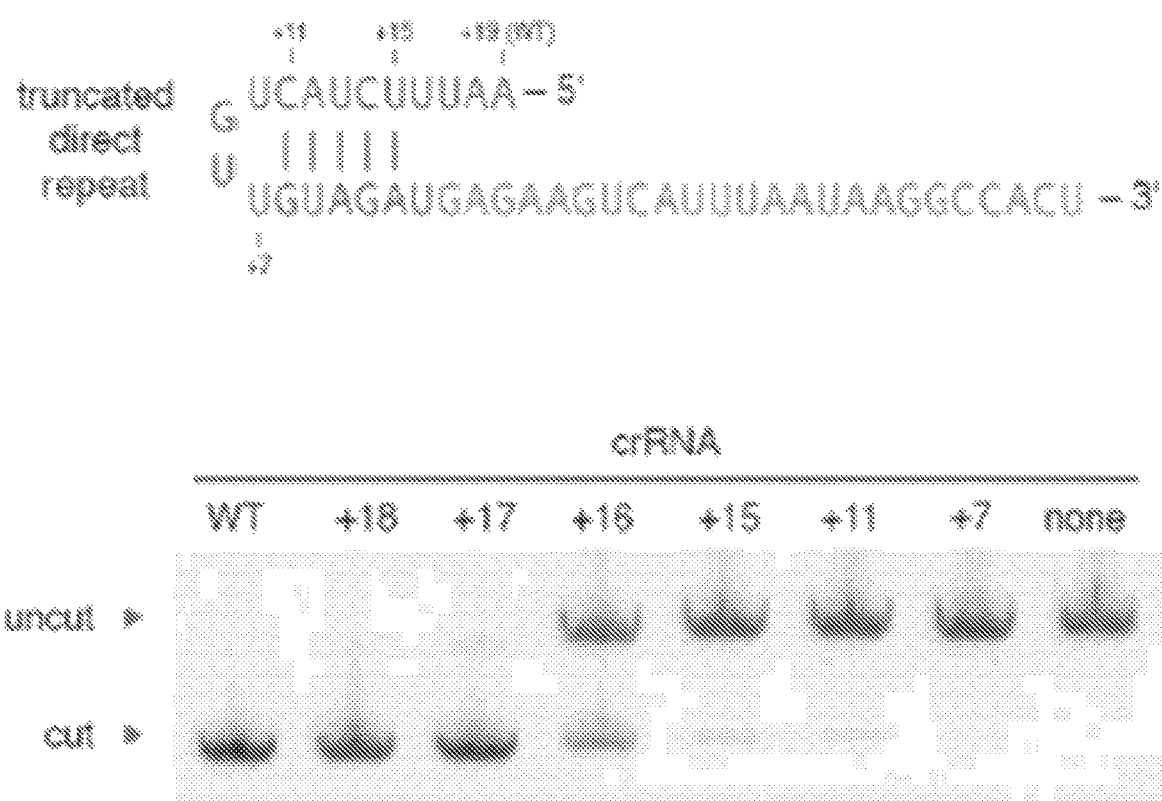

FIGS. 62A-62E shows crRNA requirements for FnCpf1 nuclease activity in vitro. FIG. 62A shows the effect of spacer length on FnCpf1 cleavage activity. FIG. 62B shows the effect of crRNA-target DNA mismatch on FnCpf1 cleavage activity. FIG. 62C demonstrates the effect of direct repeat length on FnCpf1 cleavage activity. FIG. 62D shows FnCpf1 cleavage activity depends on secondary structure in the stem of the direct repeat RNA structure. FIG. 62E shows FnCpf1 cleavage activity is unaffected by loop mutations but is sensitive to mutation in the 3'-most base of the direct repeat. SEQ ID NOS 591-617, respectively, disclosed in order of appearance.

Figure 63A:
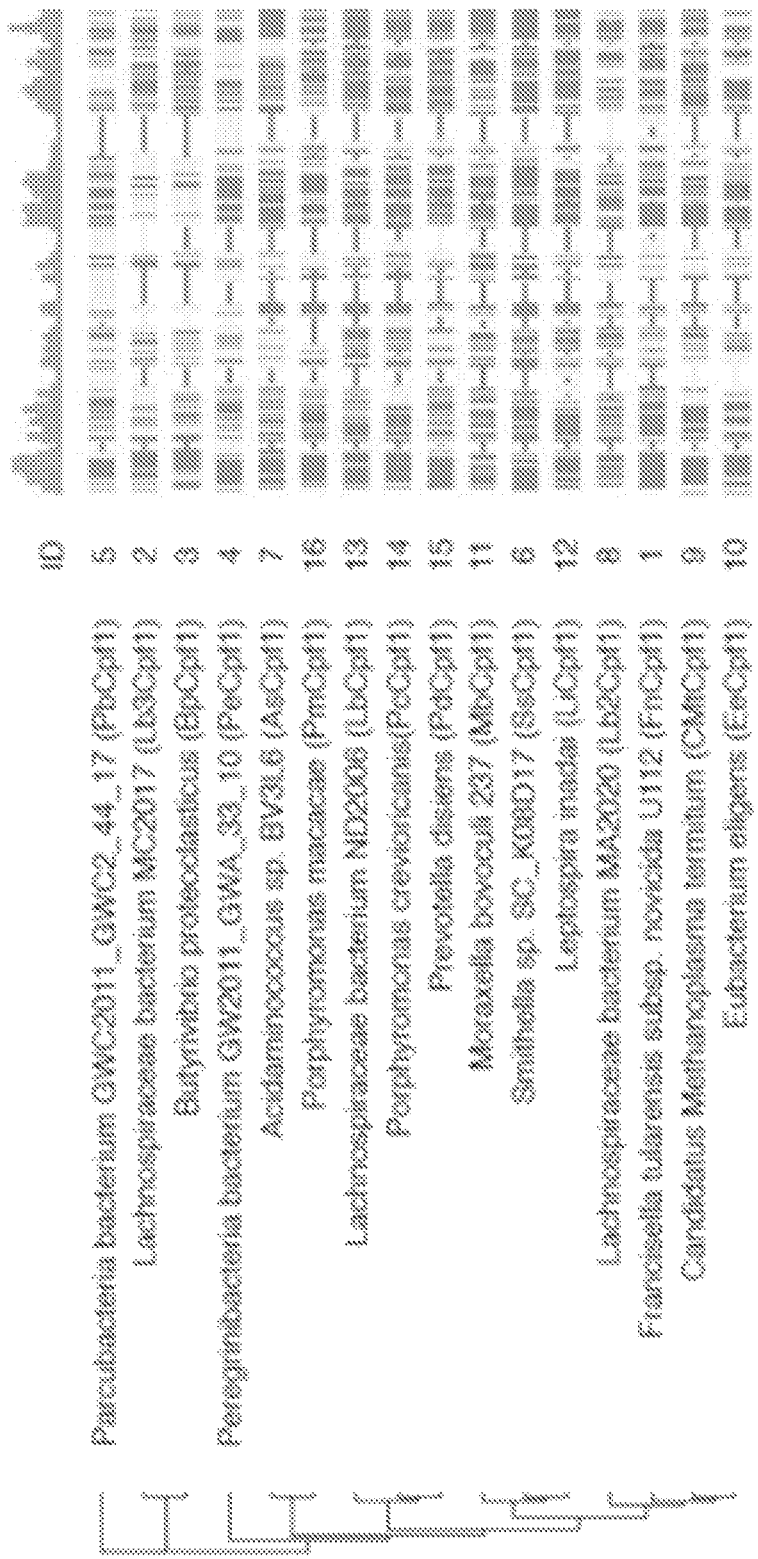
Figure 63B:
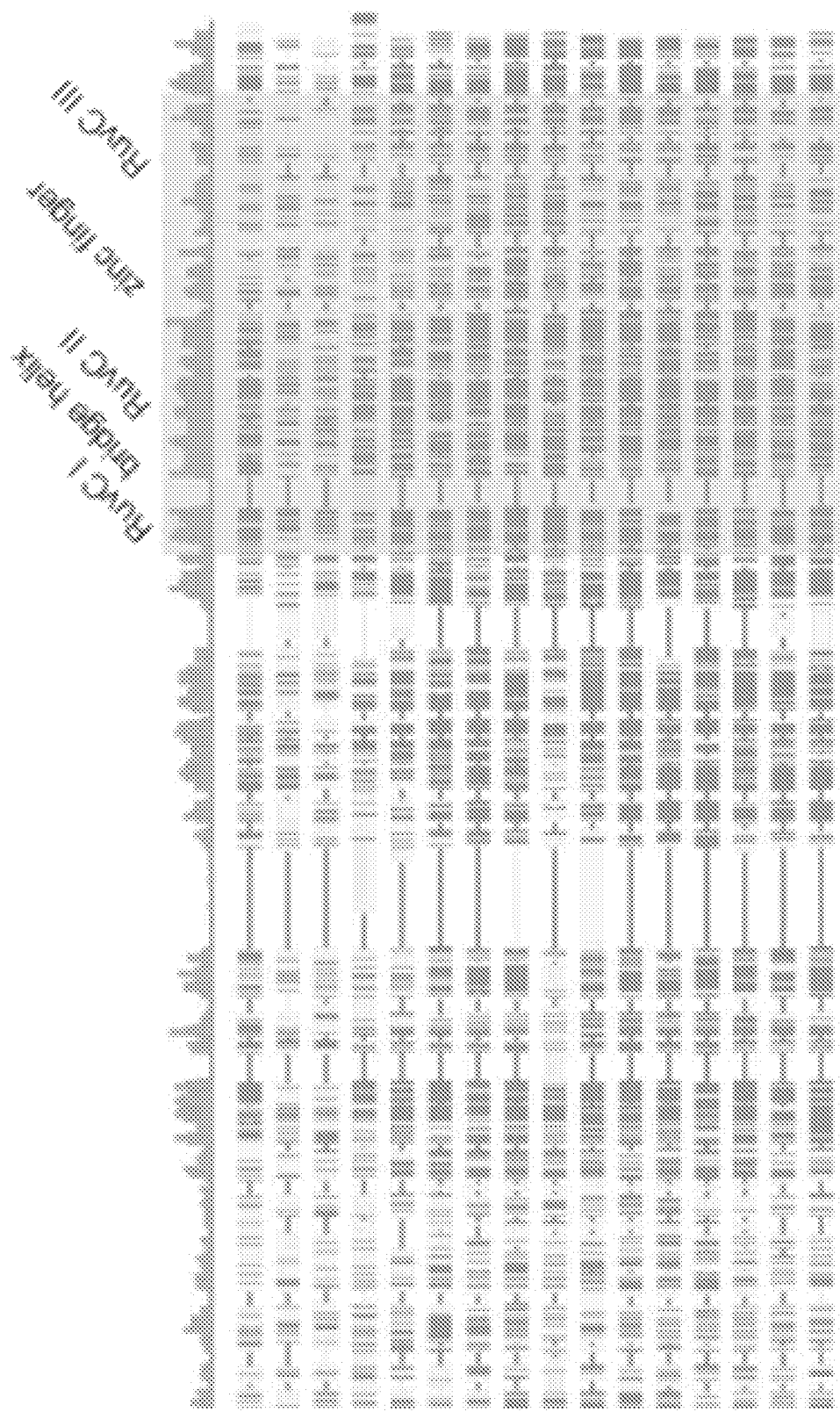
Figure 63D:
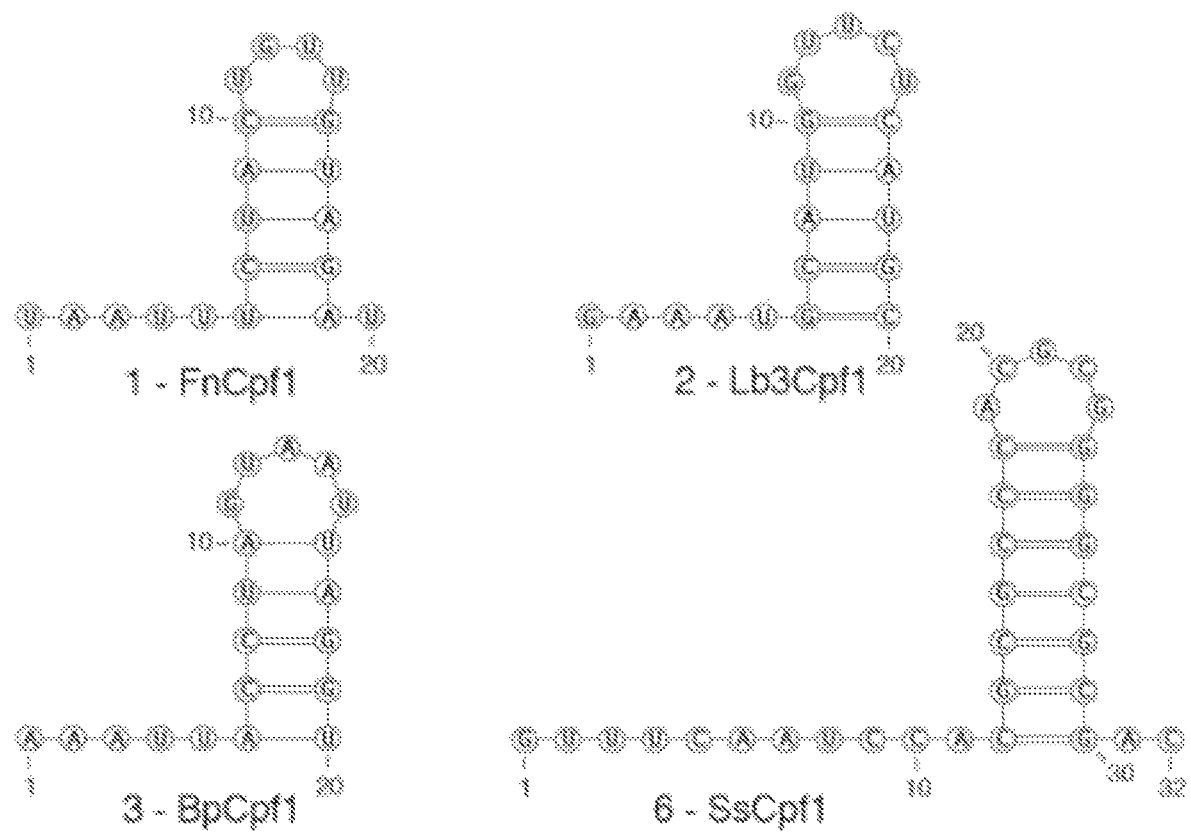
Figure 63F:
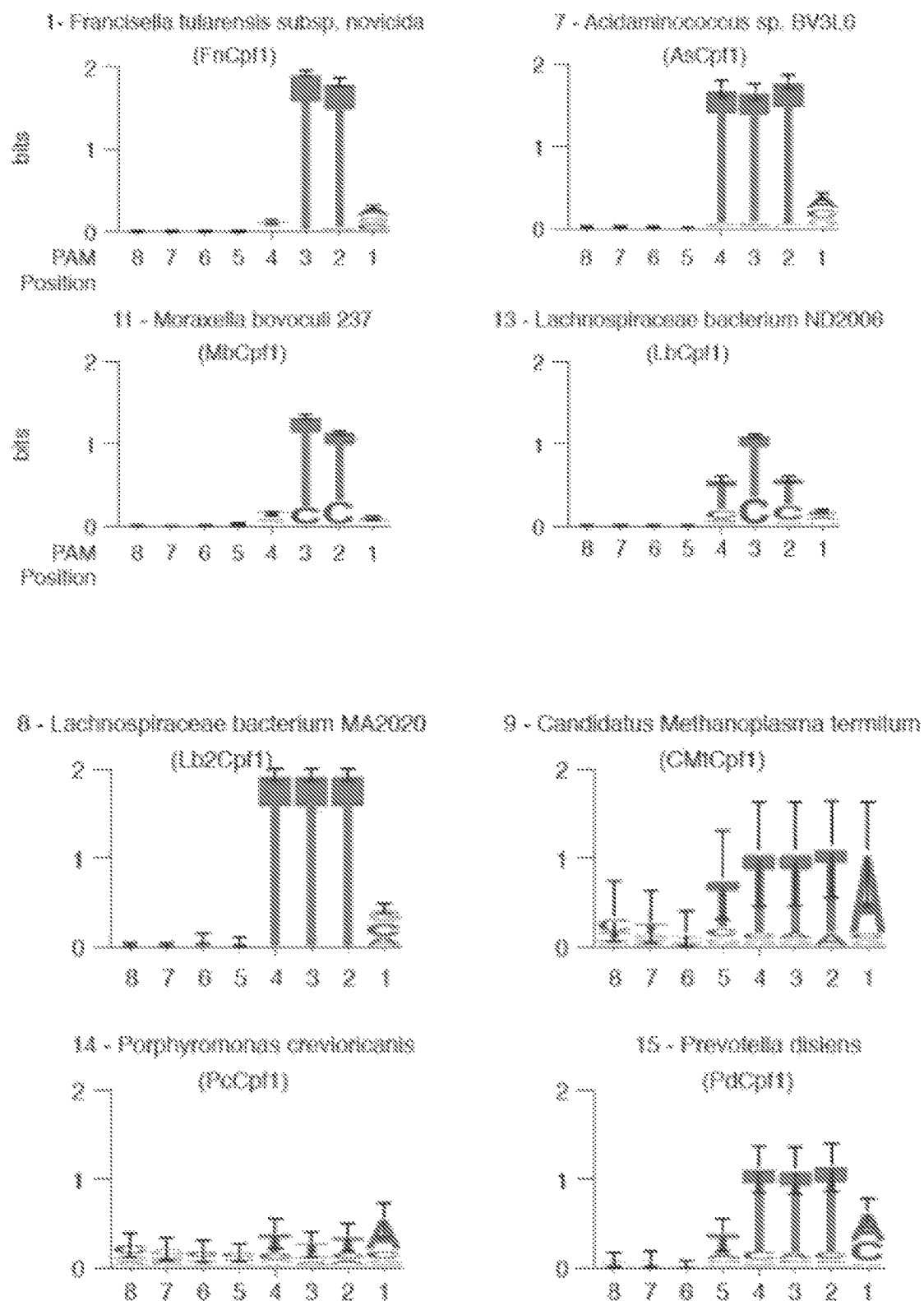

FIGS. 63A-63F provides an analysis of Cpf1-family protein diversity and function. FIGS. 63A-63B show a phylogenetic comparison of 16 Cpf1 orthologs selected for functional analysis. Conserved sequences are shown in dark gray. The RuvC domain, bridge helix, and zinc finger are highlighted. FIG. 63C shows an alignment of direct repeats from the 16 Cpf1-family proteins. Sequences that are removed post crRNA maturation are colored gray. Non-conserved bases are colored red. The stem duplex is highlighted in gray. FIG. 63D depicts RNAfold (Lorenz et al., 2011) prediction of the direct repeat sequence in the mature crRNA. Predictions for FnCpf1 along with three less-conserved orthologs shown. FIG. 63E shows ortholog crRNAs with similar direct repeat sequences are able to function with FnCpf1 to mediate target DNA cleavage. FIG. 63F shows PAM sequences for 8 Cpf1-family proteins identified using in vitro cleavage of a plasmid library containing randomized PAMs flanking the protospacer. SEQ ID NOS 618-637, respectively, disclosed in order of appearance.

Figure 64A:
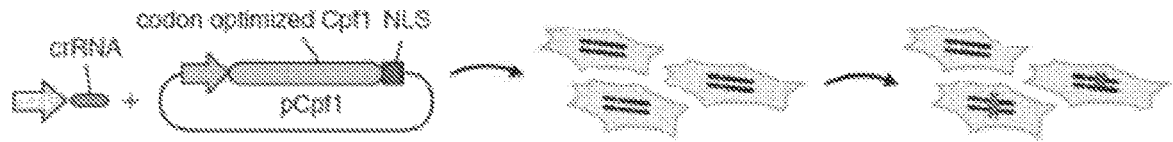
Figure 64B:
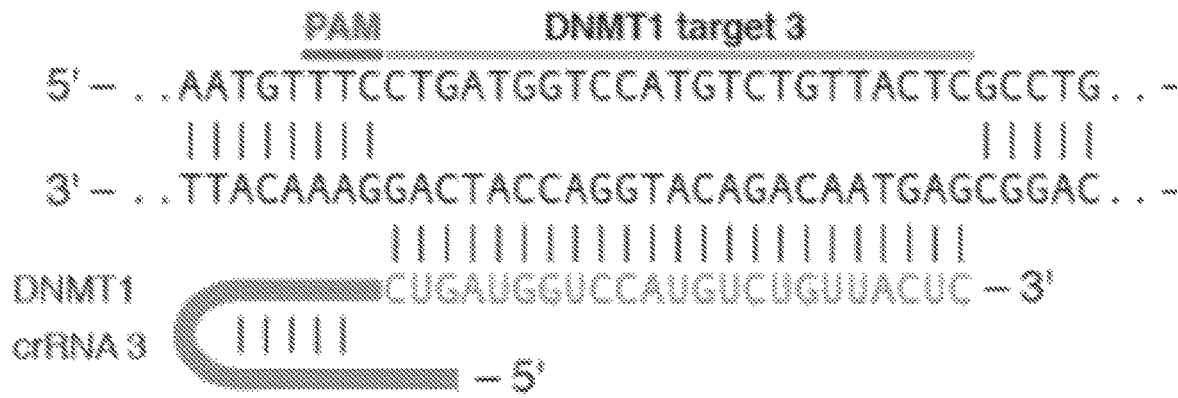
Figure 64C:
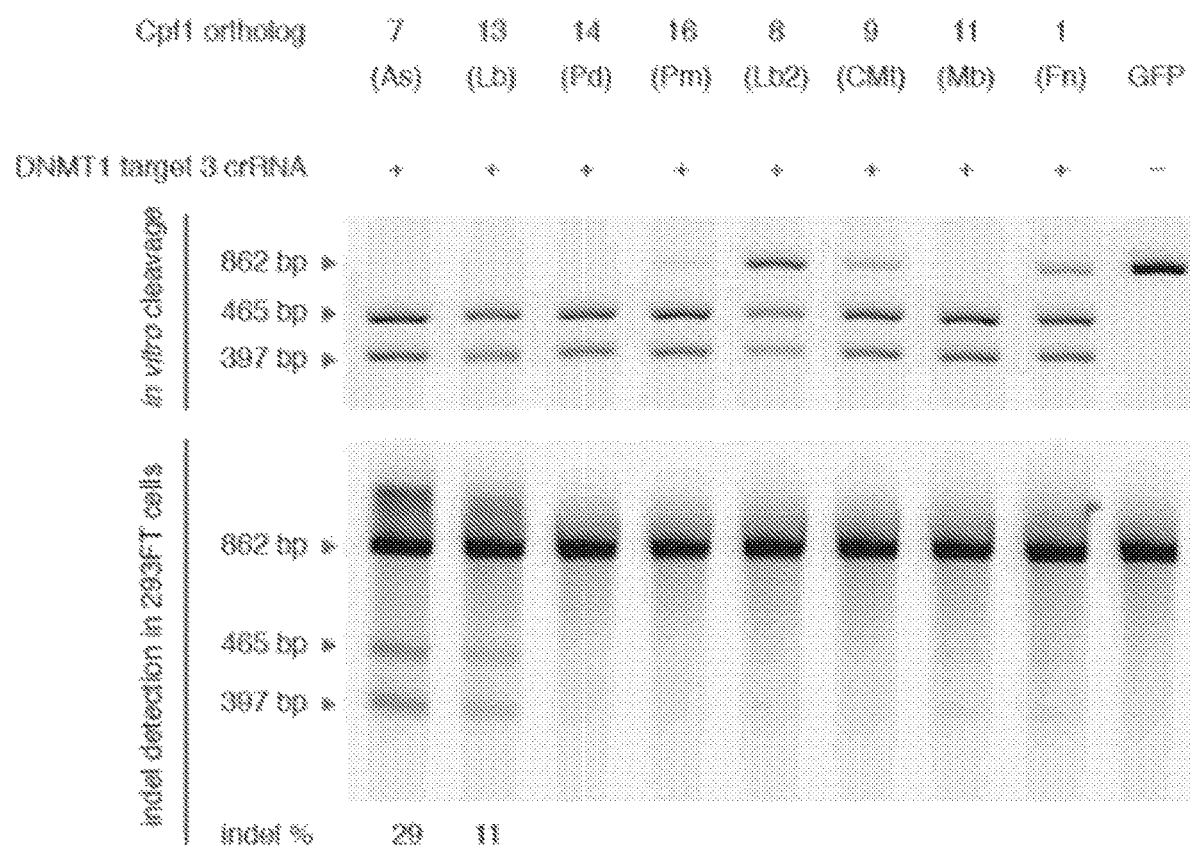
Figure 64E:
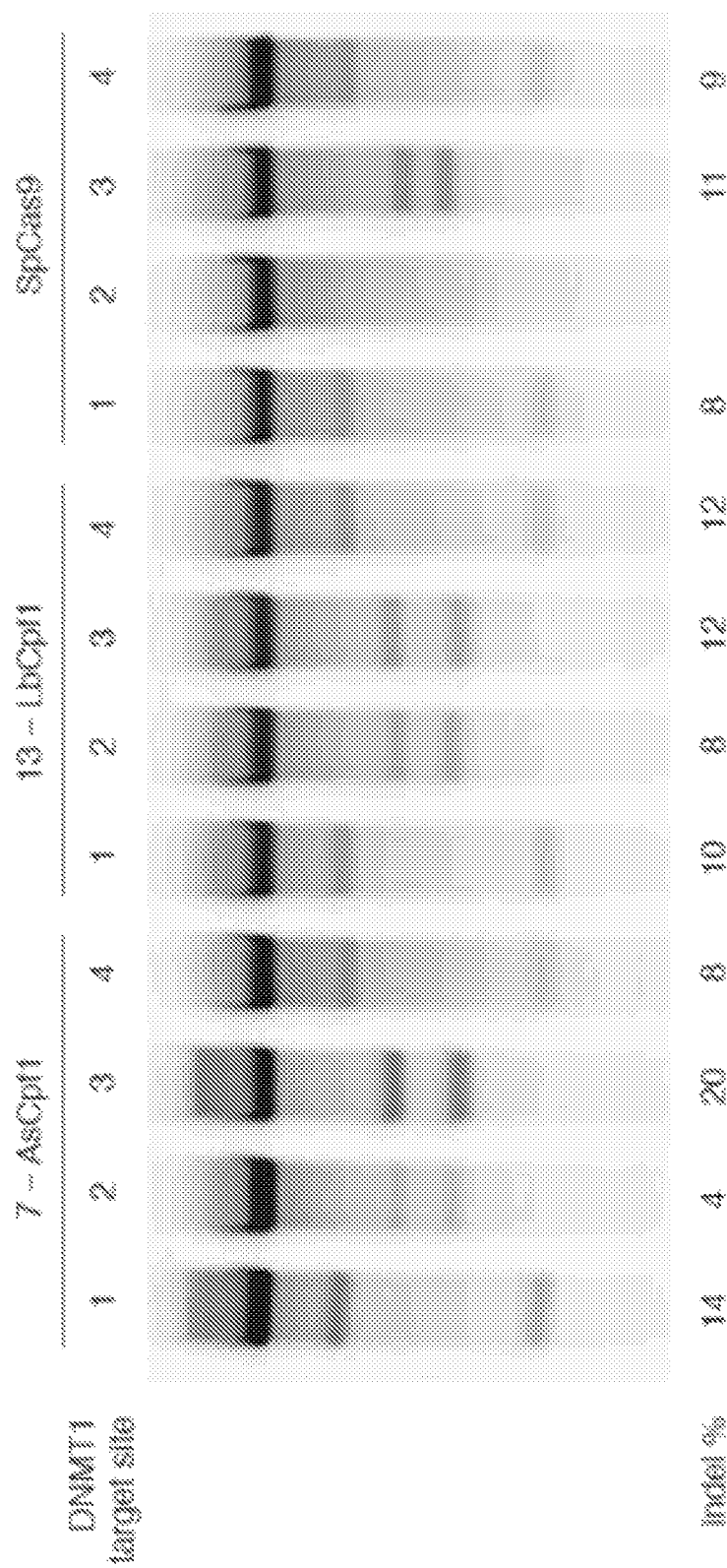

FIGS. 64A-64E shows Cpf1 mediates robust genome editing in human cell lines. FIG. 64A is a schemative showing expression of individual Cpf1-family proteins in HEK 293FT cells using CMV-driven expression vectors. The corresponding crRNA is expressed using a PCR fragment containing a U6 promoter fused to the crRNA sequence. Transfected cells were analyzed using either Surveyor nuclease assay or targeted deep sequencing. FIG. 64B (top) depicts the sequence of DNMT1-targeting crRNA 3, and sequencing reads (bottom) show representative indels. IG. 64B discloses SEQ ID NOS 638-649, respectively, in order of appearance. FIG. 64C provides a comparison of in vitro and in vivo cleavage activity. The DNMT1 target region was PCR amplified and the genomic fragment was used to test Cpf1-mediated cleavage. All 8 Cpf1-family proteins showed DNA cleavage in vitro (top). Candidates 7—AsCpf1 and 13—Lb3Cpf1 facilitated robust indel formation in human cells (bottom). FIG. 64D shows Cpf1 and SpCas9 target sequences in the human DNMT1 locus (SEQ ID NOS 650-657, respectively, disclosed in order of appearance). FIG. 64E provides a comparison of Cpf1 and SpCas9 genome editing efficiency. Target sites correspond to sequences shown in FIG. 101D.

Figure 65A:
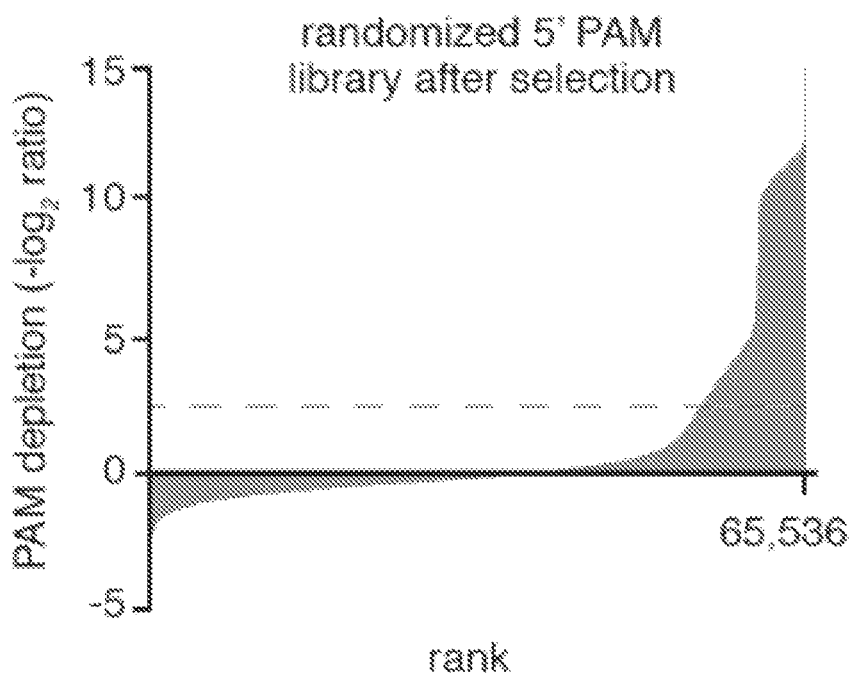
Figure 65B:
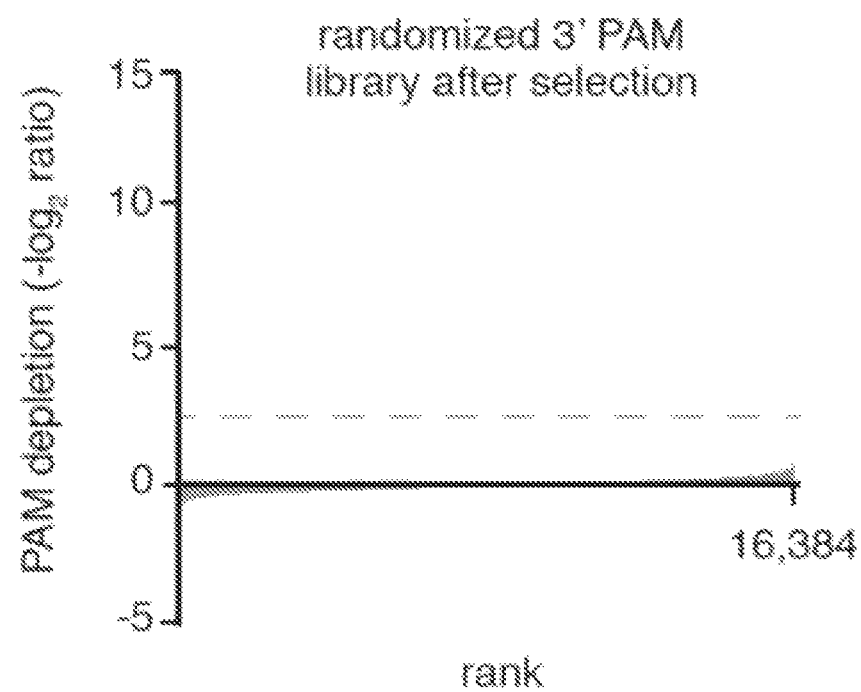
Figure 65C:
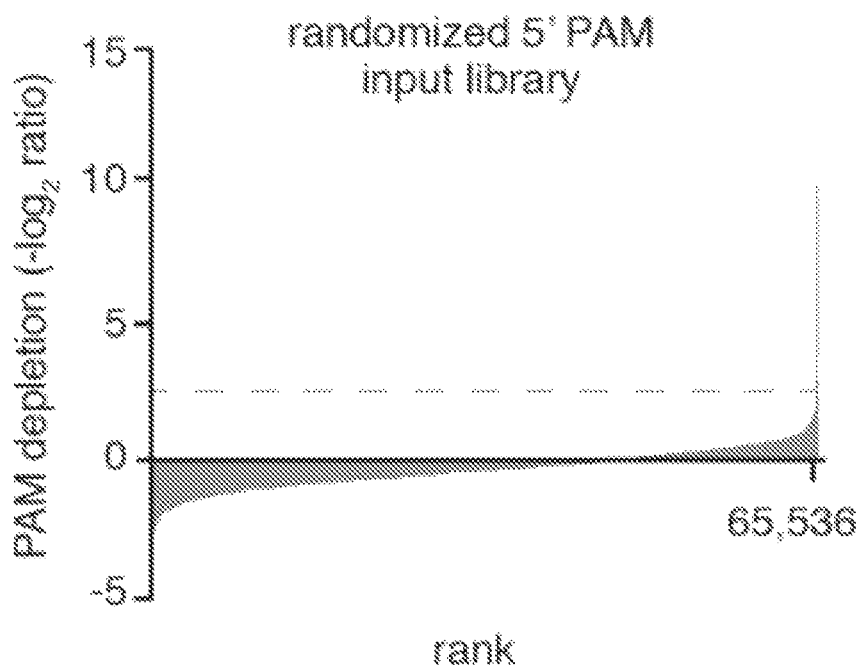
Figure 65D:
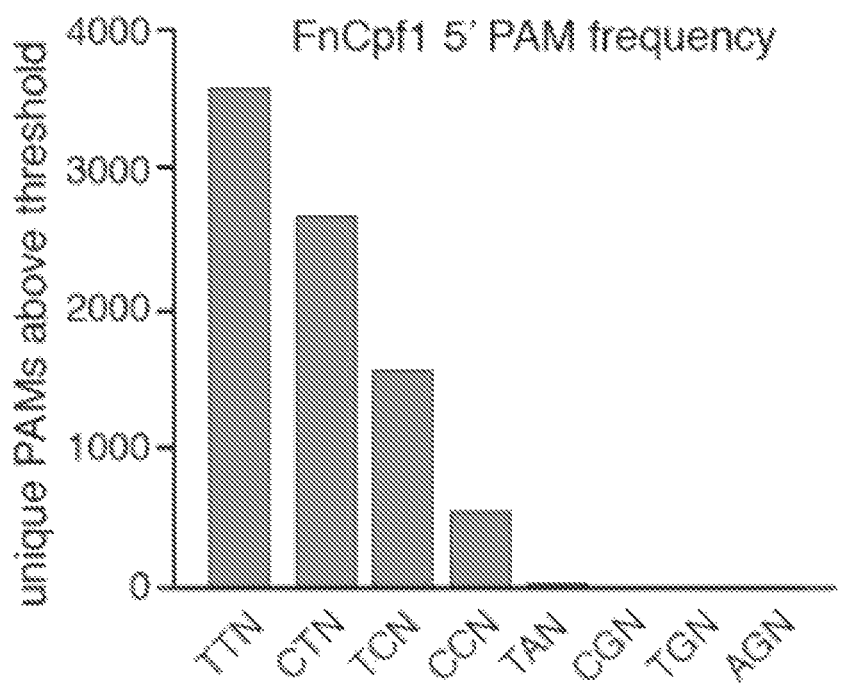

FIGS. 65A-65D shows an in vivo plasmid depletion assay for identifying FnCpf1 PAM. (See also FIG. 58). FIG. 65A: Transformation of E. coli harboring pFnCpf1 with a library of plasmids carrying randomized 5' PAM sequences. A subset of plasmids were depleted. Plot shows depletion levels in ranked order. Depletion is measured as the negative log 2 fold ratio of normalized abundance compared pACYC184 E. coli controls. PAMs above a threshold of 3.5 are used to generate sequence logos. FIG. 65B: Transformation of E. coli harboring pFnCpf1 with a library of plasmids carrying randomized 3' PAM sequences. A subset of plasmids were depleted. Plot shows depletion levels in ranked order. Depletion is measured as the negative log 2 fold ratio of normalized abundance compared pACYC184 E. coli controls and PAMs above a threshold of 3.5 are used to generate sequence logos. FIG. 65C: Input library of plasmids carrying randomized 5' PAM sequences. Plot shows depletion levels in ranked order. Depletion is measured as the negative log 2 fold ratio of normalized abundance compared pACYC184 E. coli controls. PAMs above a threshold of 3.5 are used to generate sequence logos. FIG. 65D: The number of unique PAMs passing significance threshold for pairwise combinations of bases at the 2 and 3 positions of the 5' PAM.

Figure 66A:
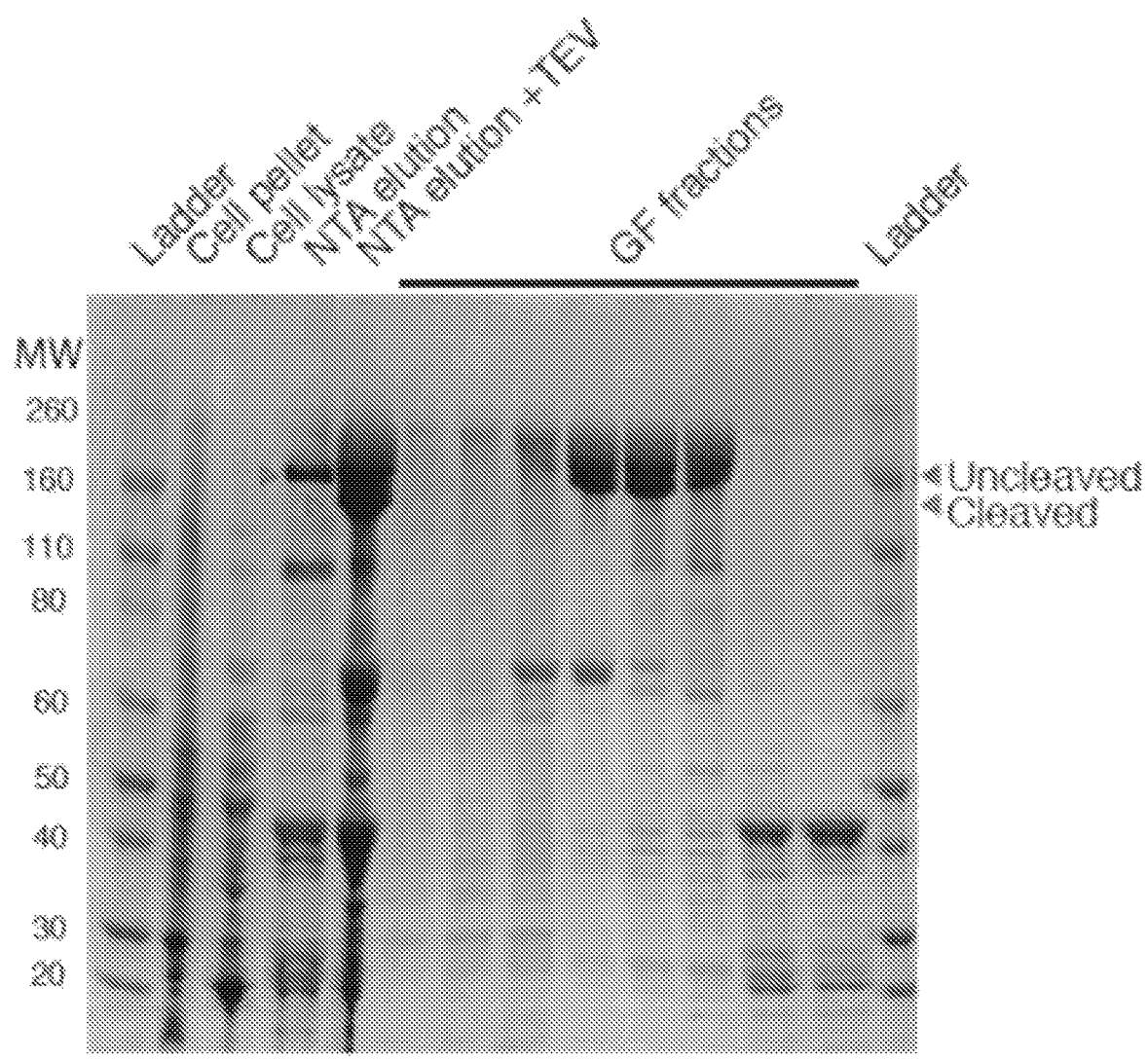
Figure 66B:
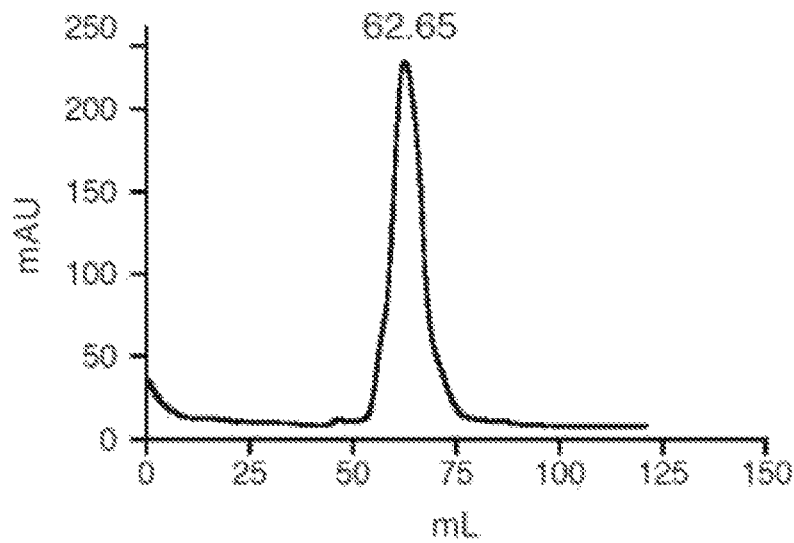
Figure 66C:
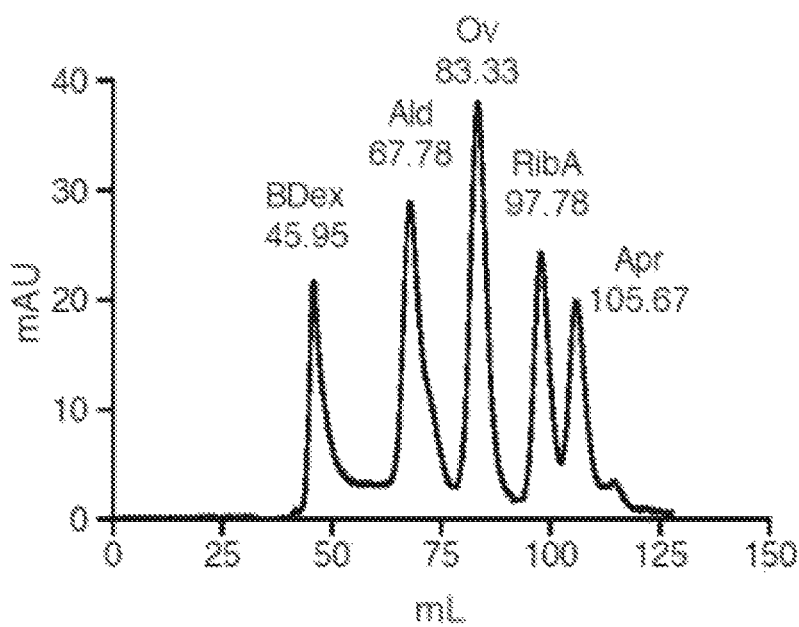
Figure 66D:
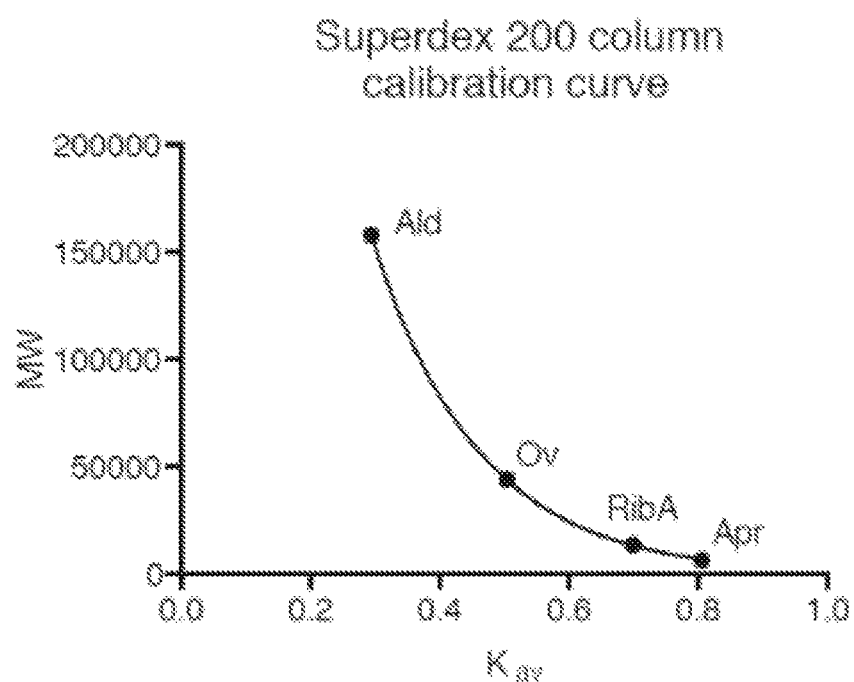
Figure 67A:
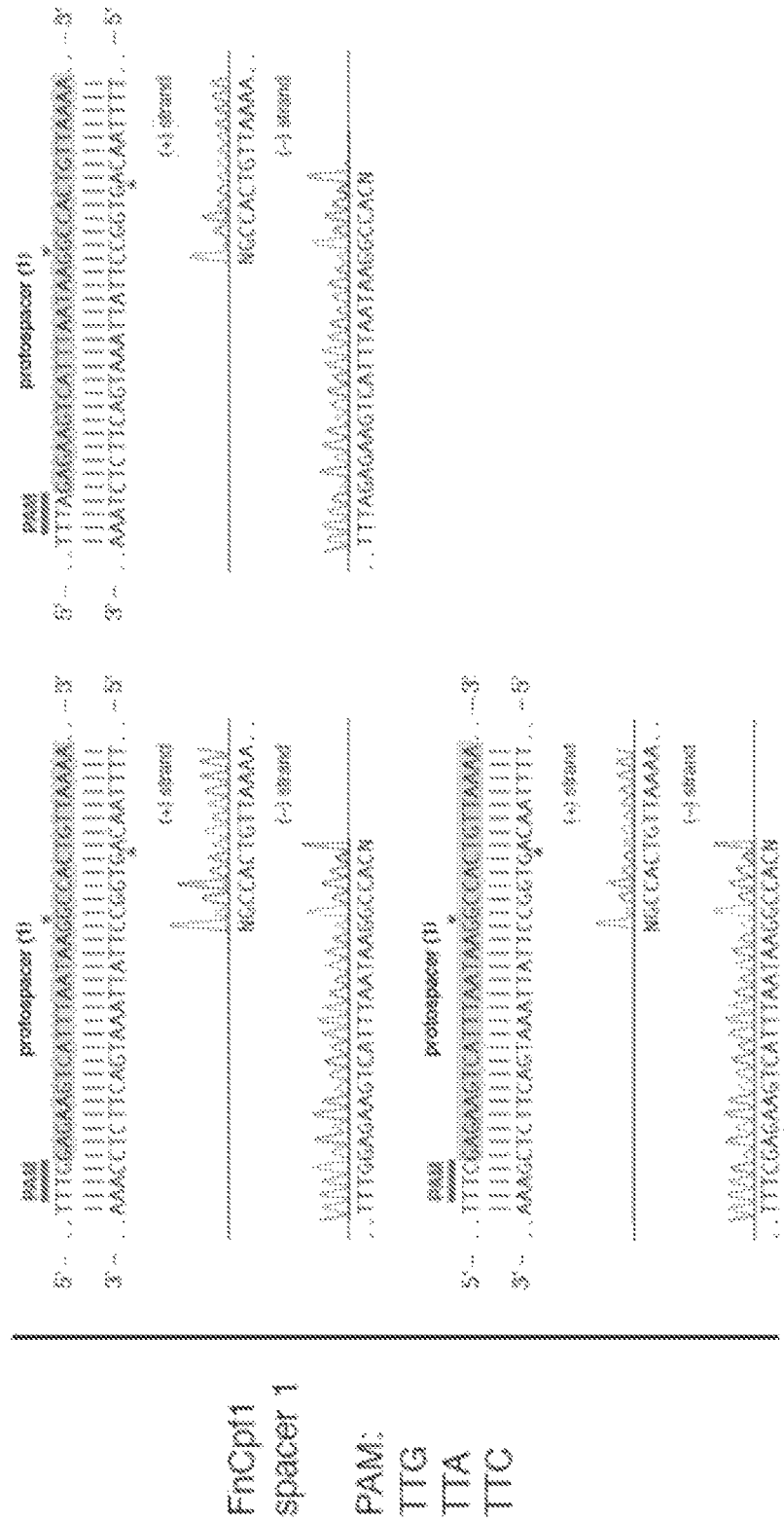
Figure 67B:
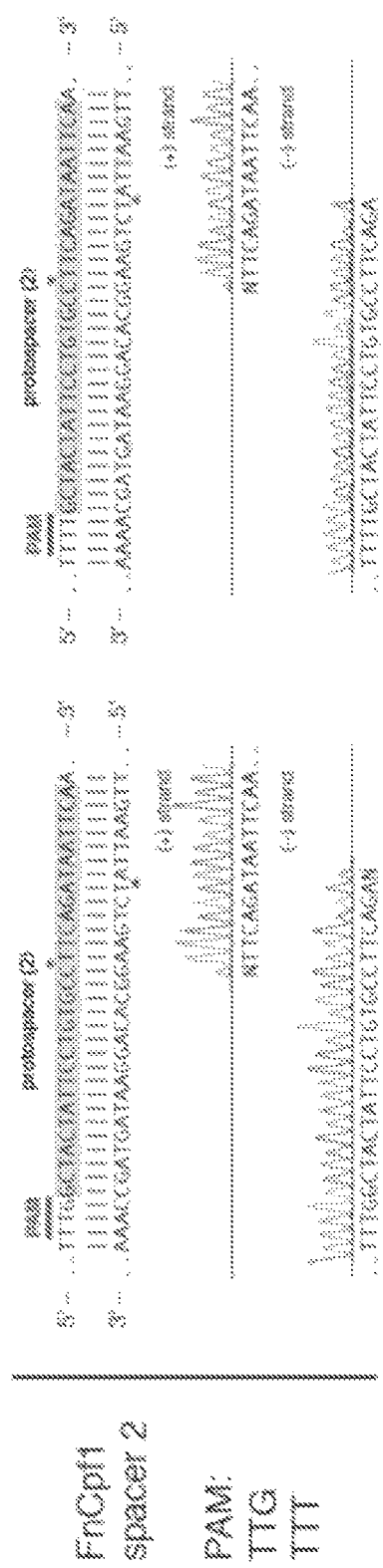
Figure 67C:
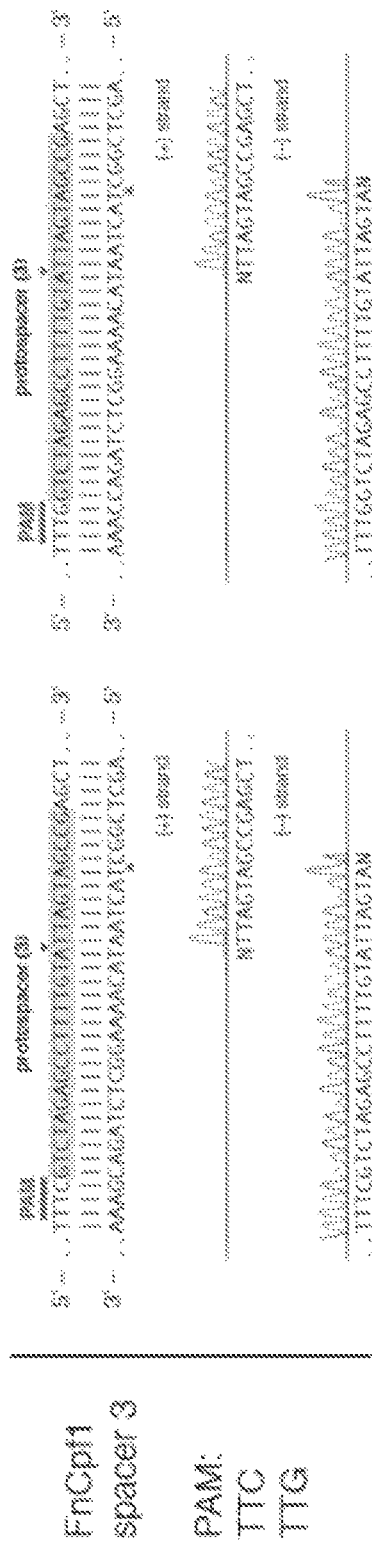
Figure 67D:
Figure 67E:
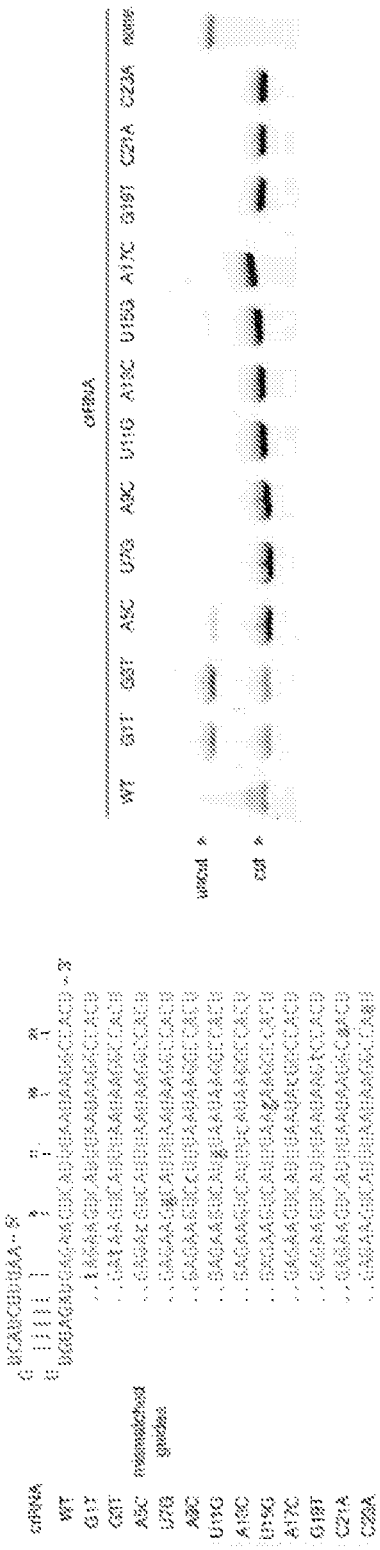

FIGS. 66A-66D shows FnCpf1 Protein Purification. (See also FIG. 60). FIG. 66A depicts a Coomassie blue stained acrylamide gel of FnCpf1 showing stepwise purification. A band just above 160 kD eluted from the Ni-NTA column, consistent with the size of a MBP-FnCpf1 fusion (189.7 kD). Upon addition of TEV protease a lower molecular weight band appeared, consistent with the size of 147 kD free FnCpf1. FIG. 66B: Size exclusion gel filtration of fnCpf1. FnCpf1 eluted at a size approximately 300 kD (62.65 mL), suggesting Cpf1 may exist in solution as a dimer. FIG. 66C shows protein standards used to calibrate the Superdex 200 column. BDex=Blue Dextran (void volume), Ald=Aldolase (158 kD), Ov=Ovalbumin (44 kD), RibA=Ribonuclease A (13.7 kD), Apr=Aprotinin (6.5 kD). FIG. 66D: Calibration curve of the Superdex 200 column. $K_a$ is calculated as (elution volume−void volume)/(geometric column volume−void volume). Standards were plotted and fit to a logarithmic curve.

FIGS. 67A-67E shows cleavage patterns of FnCpf1. (See also FIG. 60). Sanger sequencing traces from FnCpf1-digested DNA targets show staggered overhangs. The non-templated addition of an additional adenine, denoted as N, is an artifact of the polymerase used in sequencing. Sanger traces are shown for different TTN PAMs with protospacer 1 (A), protospacer 2 (B), and protospacer 3 (C) and targets DNMT1 and EMX1 (D). The (−) strand sequence is reverse-complemented to show the top strand sequence. Cleavage sites are indicated by red triangles. Smaller triangles indicate putative alternative cleavage sites. Panel E shows the effect of PAM-distal crRNA-target DNA mismatch on FnCpf1 cleavage activity. SEQ ID NOS 658-697, respectively, disclosed in order of appearance.

FIGS. 68A-68B shows an amino acid sequence alignment of FnCpf1 (SEQ ID NOS 698 and 701), AsCpf1 (SEQ ID NOS 699 and 702), and LbCpf1 (SEQ ID NOS 700 and 703). (See also FIG. 63). Residues that are conserved are highlighted with a red background and conserved mutations are highlighted with an outline and red font. Secondary structure prediction is highlighted above (FnCpf1) and below (LbCpf1) the alignment. Alpha helices are shown as a curly symbol and beta strands are shown as dashes. Protein domains identified in FIG. 95A are also highlighted.

FIGS. 69A-69D provides maps bacterial genomic loci corresponding to the 16 Cpf1-family proteins selected for mammalian experimentation. (See also FIG. 63). FIGS. 69A-69D disclose SEQ ID NOS 704-719, respectively, in order of appearance.

Figure 70A:
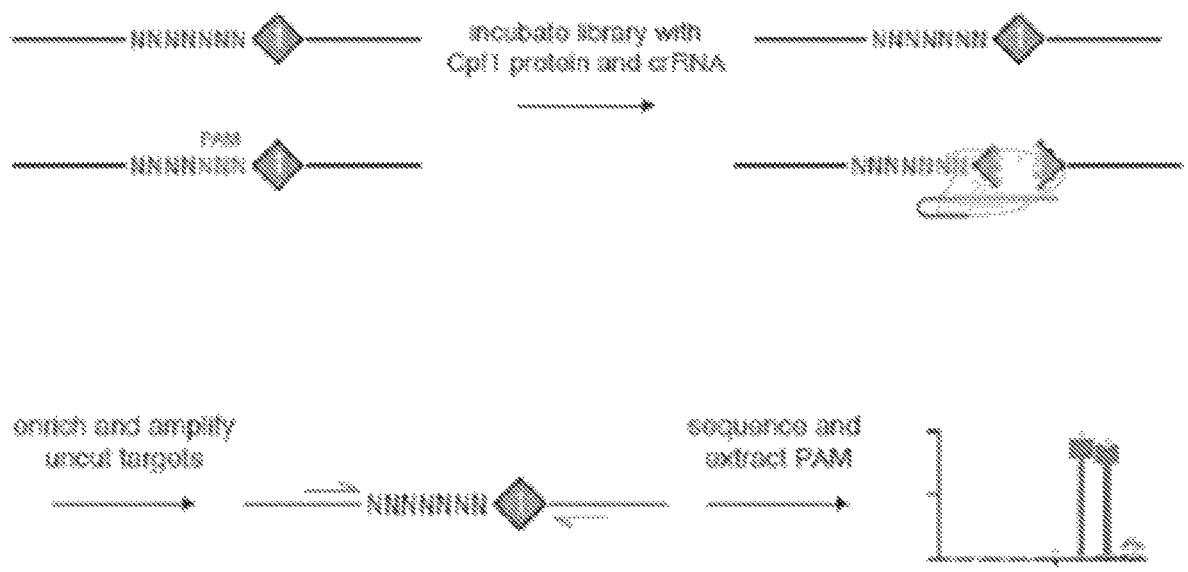
Figure 70B:
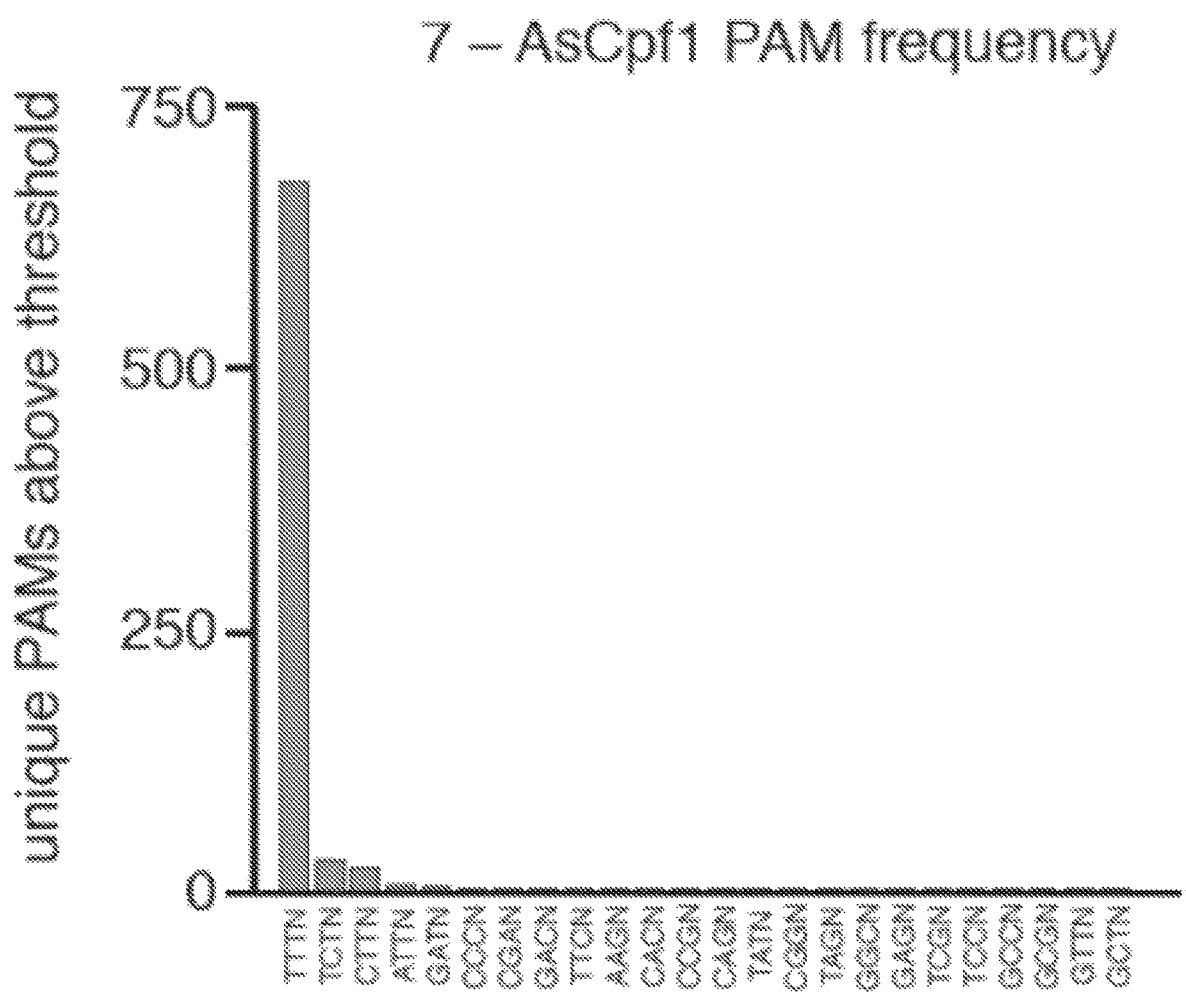
Figure 70C:
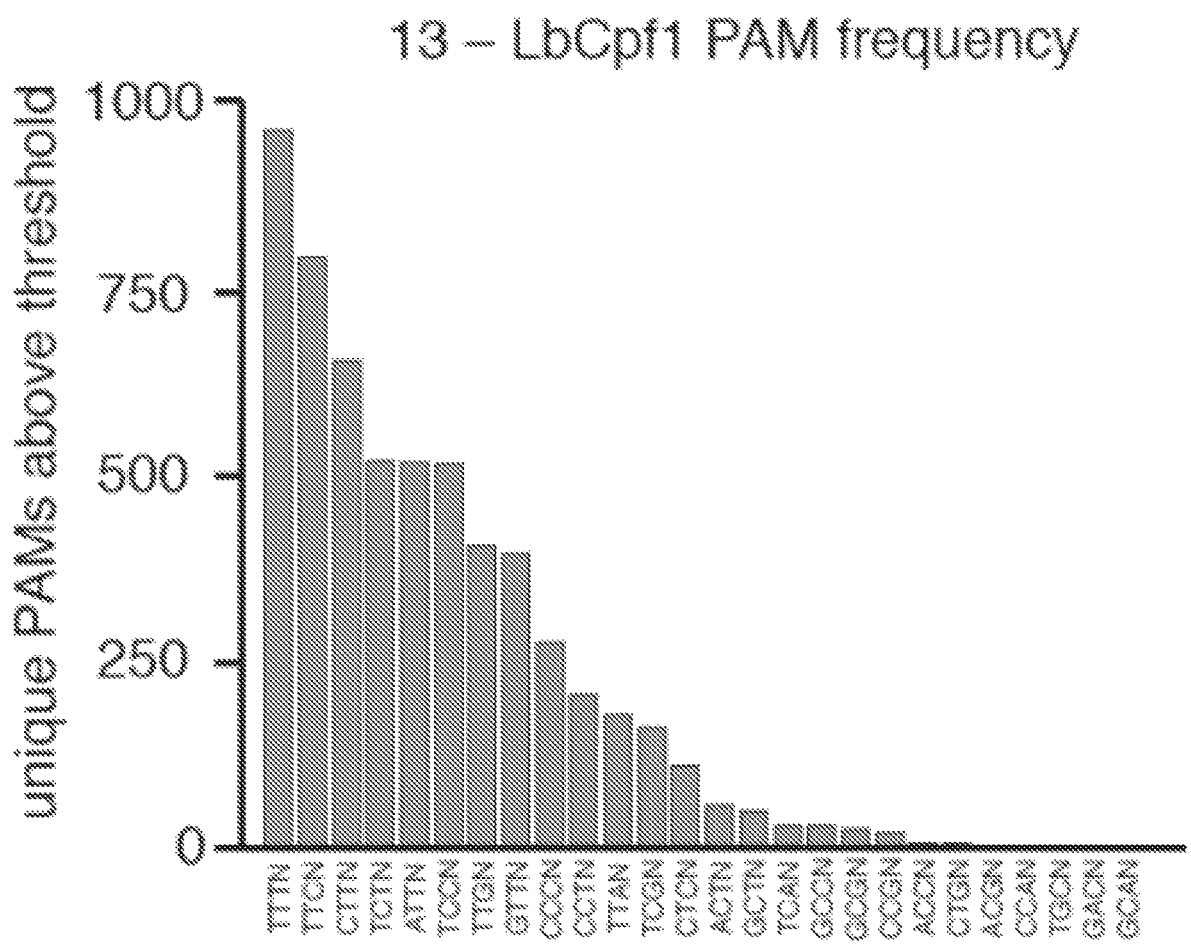
Figure 70D:
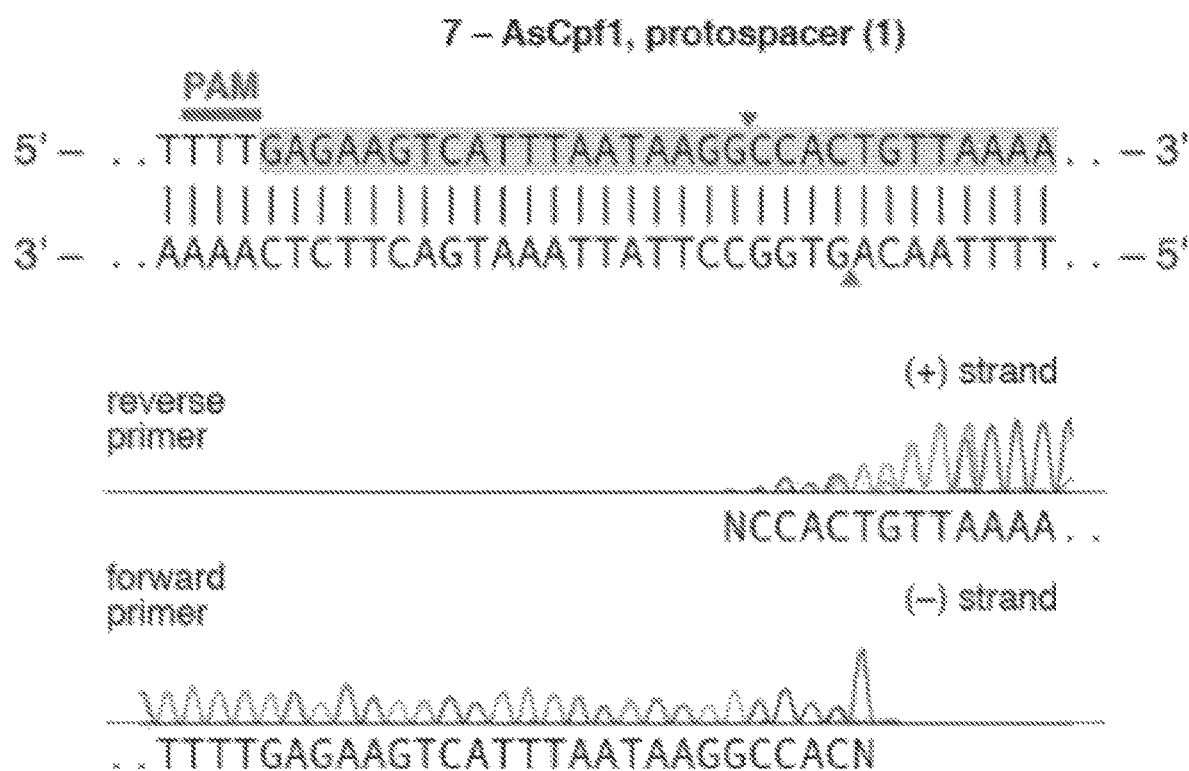
Figure 70E:
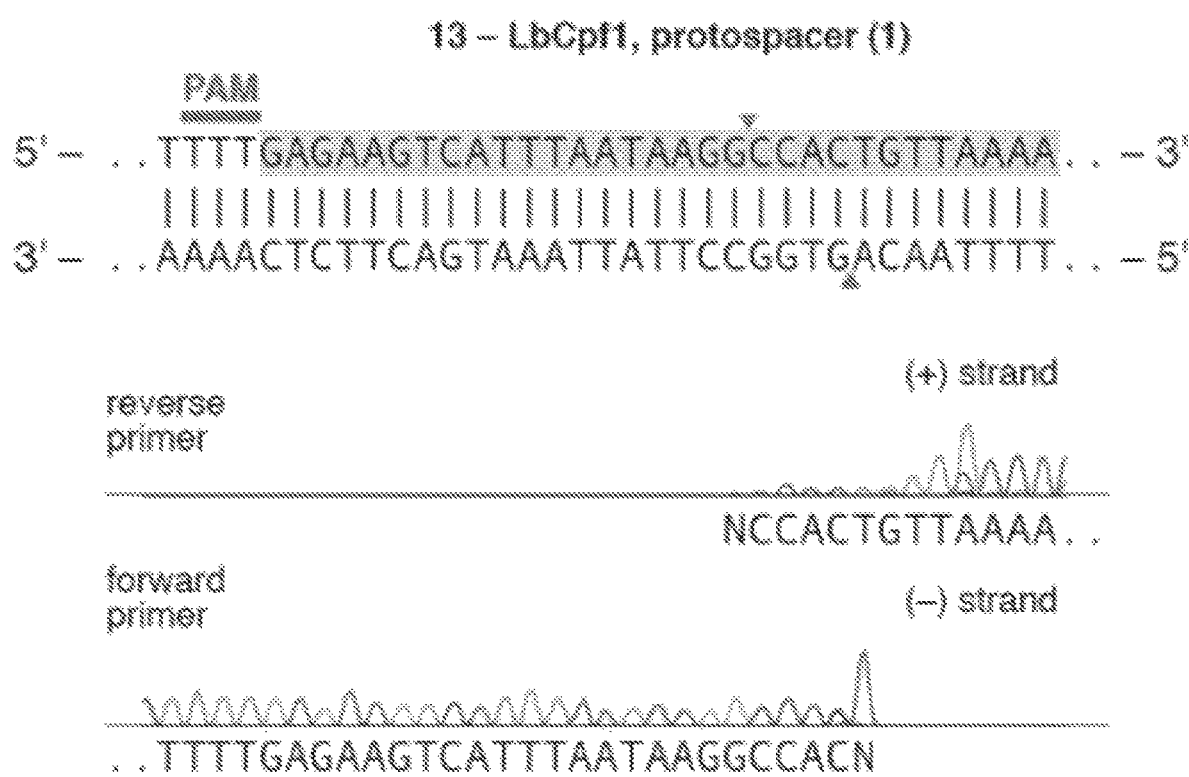

FIGS. 70A-70E shows in vitro characterization of Cpf1-family proteins. FIG. 70A is a schematic for in vitro PAM screen using Cpf1-family proteins. A library of plasmids bearing randomized 5' PAM sequences were cleaved by individual Cpf1-family proteins and their corresponding crRNAs. Uncleaved plasmid DNA was purified and sequenced to identify specific PAM motifs that were depleted. FIG. 70B indicates the number of unique sequences passing significance threshold for pairwise combinations of bases at the 2 and 3 positions of the 5' PAM for 7—AsCpf1. FIG. 70C indicates the number of unique PAMs passing significance threshold for triple combinations of bases at the 2, 3, and 4 positions of the 5' PAM for 13—LbCpf1.

FIGS. 70D-70E E and F show Sanger sequencing traces from 7—AsCpf1-digested target (E) and 13—LbCpf1-digested target (F) and show staggered overhangs. The non-templated addition of an additional adenine, denoted as N, is an artifact of the polymerase used in sequencing. Cleavage sites are indicated by red triangles. Smaller triangles indicate putative alternative cleavage sites. FIG. 70D-E discloses SEQ ID NOS 720-725, respectively, in order of appearance.

Figure 71A:
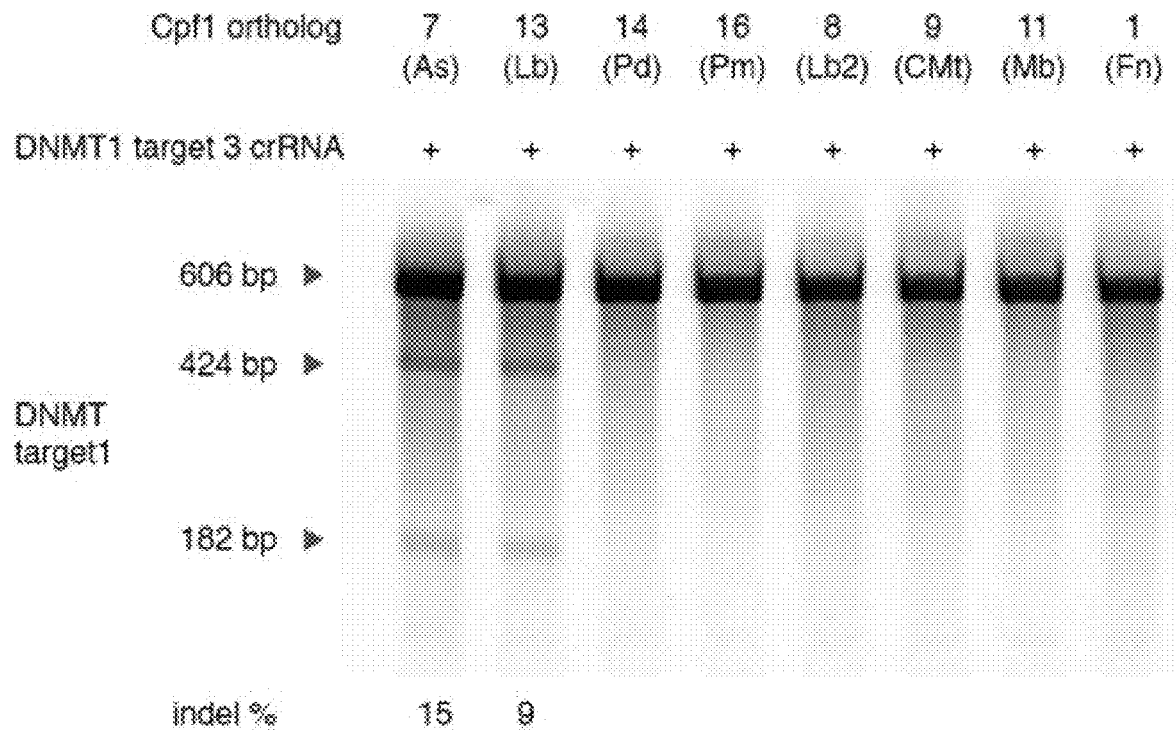
Figure 71B:
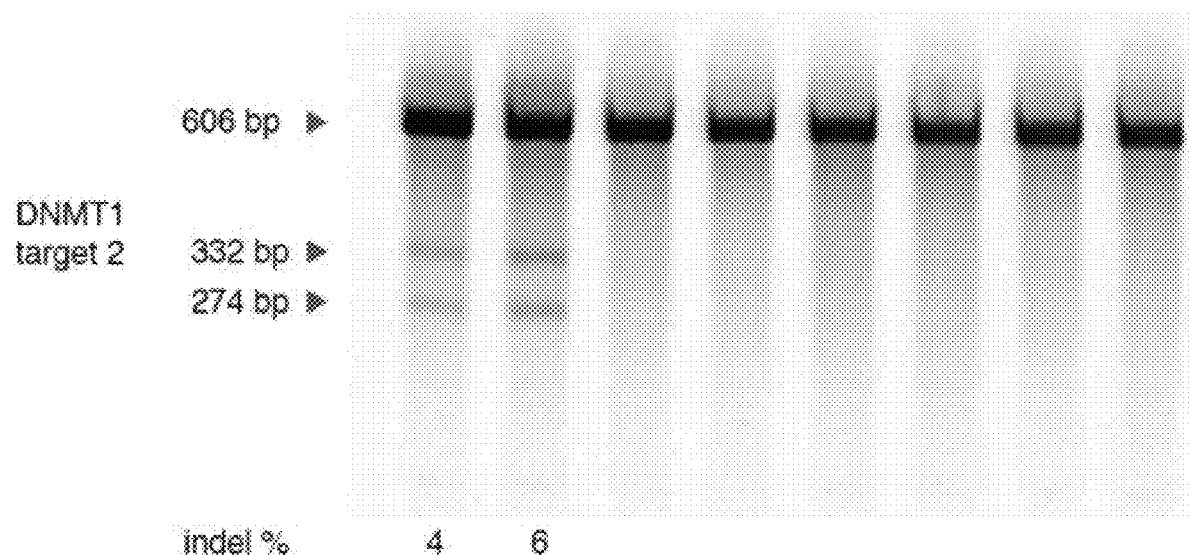
Figure 71C:
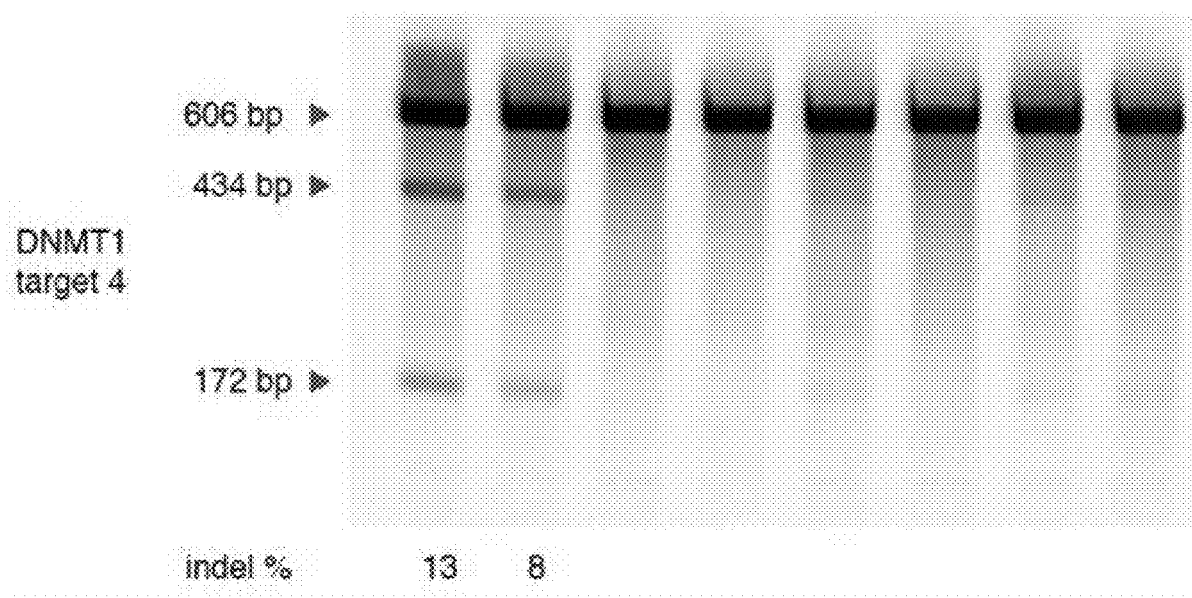
Figure 71D:
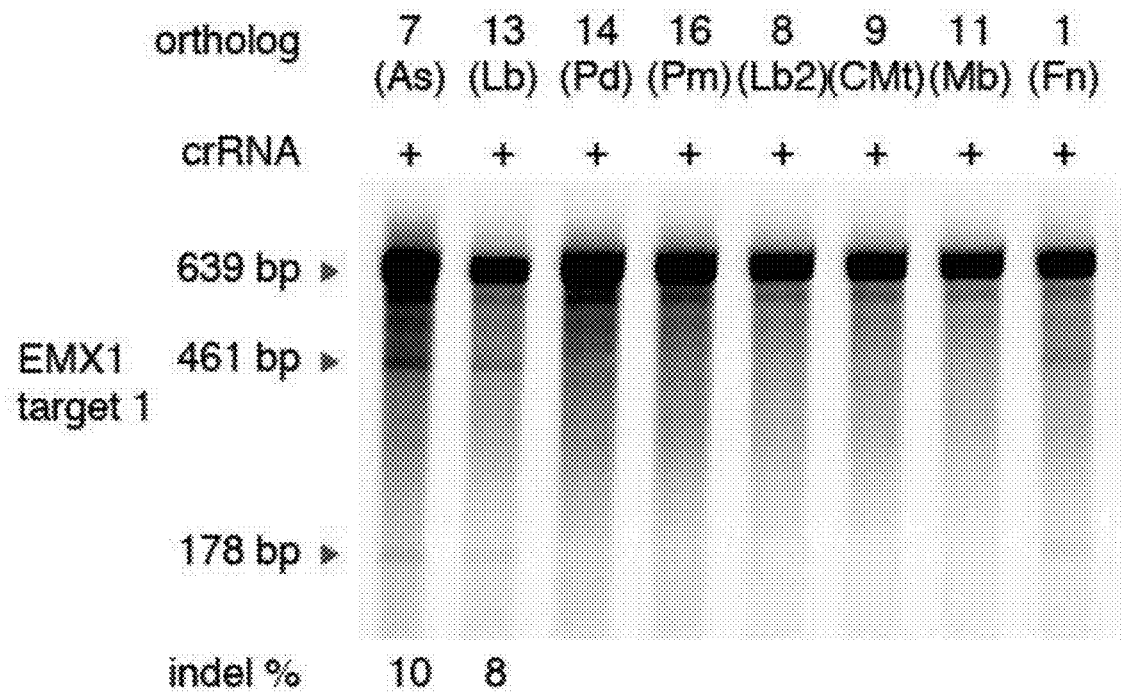
Figure 71E:
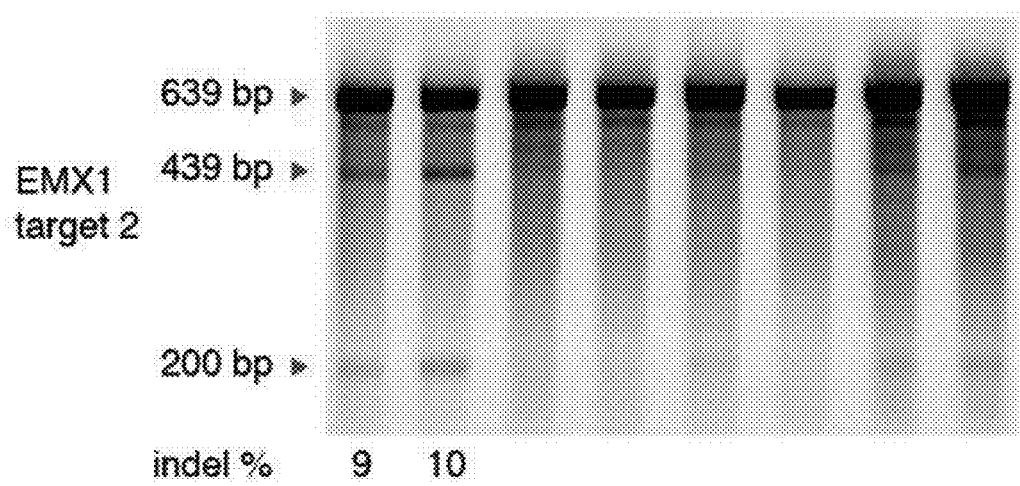
Figure 71F:
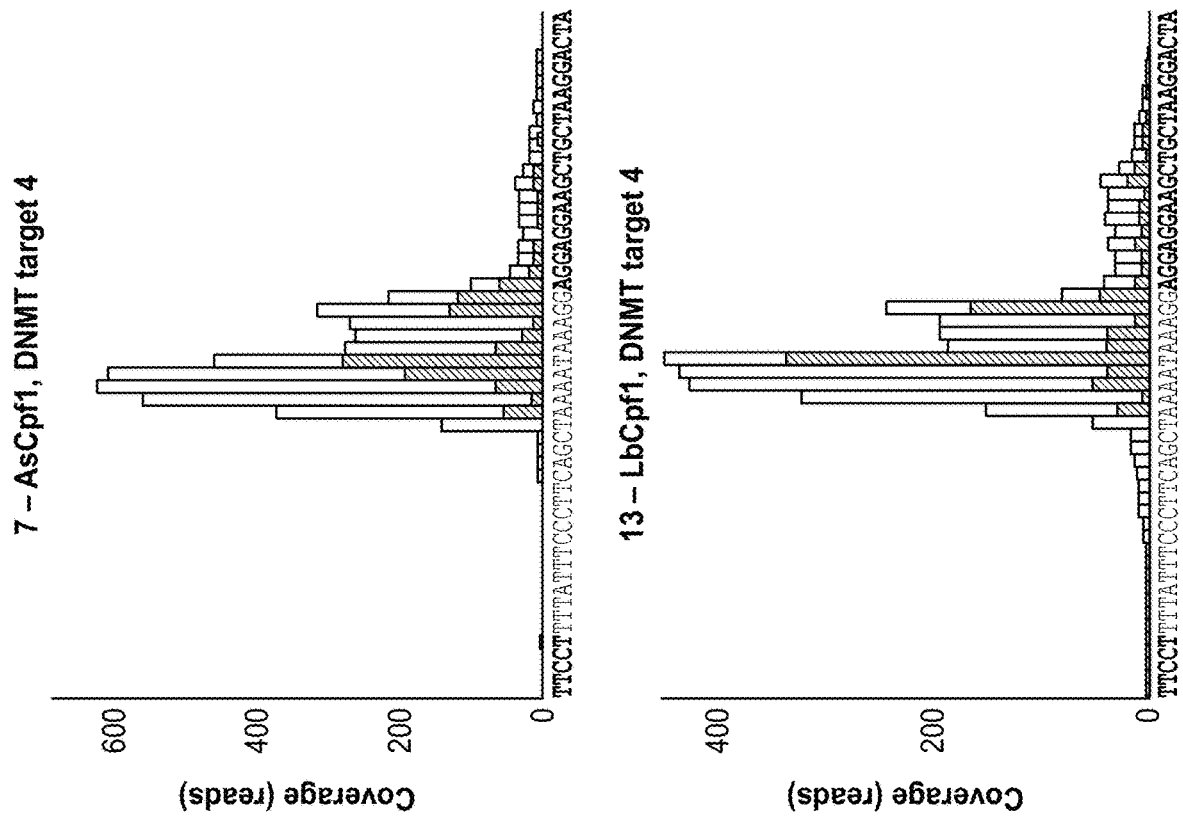

FIGS. 71A-71F indicates human cell genome editing efficiency at additional loci. Surveyor gels show quantification of indel efficiency achieved by each Cpf1-family protein at DNMT1 target sites 1 (FIG. 71A), 2 (FIG. 71B), and 4 (FIG. 71C). FIGS. 71A-71C indicate human cell genome editing efficiency at additional loci and Sanger sequencing of cleaved of DNMT target sites. Surveyor gels show quantification of indel efficiency achieved by each Cpf1-family protein at EMX1 target sites 1 and 2. Indel distributions for AsCpf1 and LbCpf1 and DNMT1 target sites 2, 3, and 4. Cyan bars represent total indel coverage; blue bars represent distribution of 3' ends of indels. For each target, PAM sequence is in red and target sequence is in light blue.

Figure 72A:
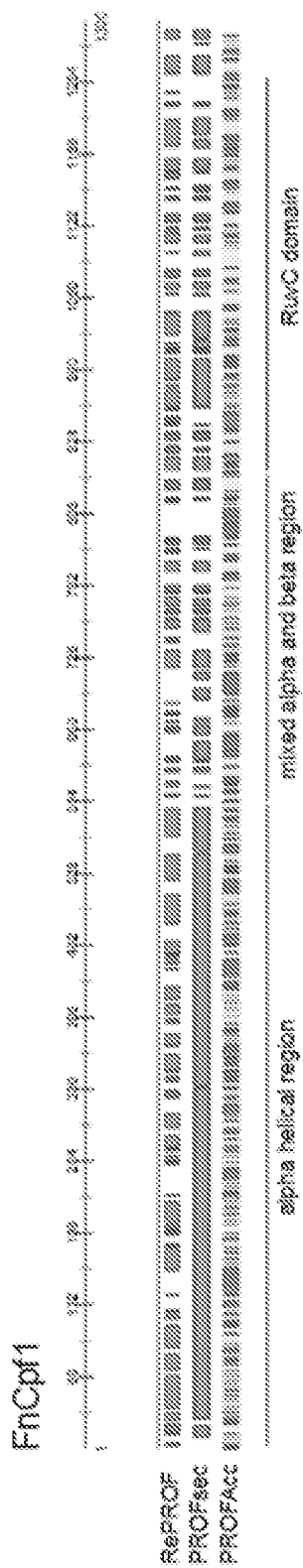
Figure 72B:
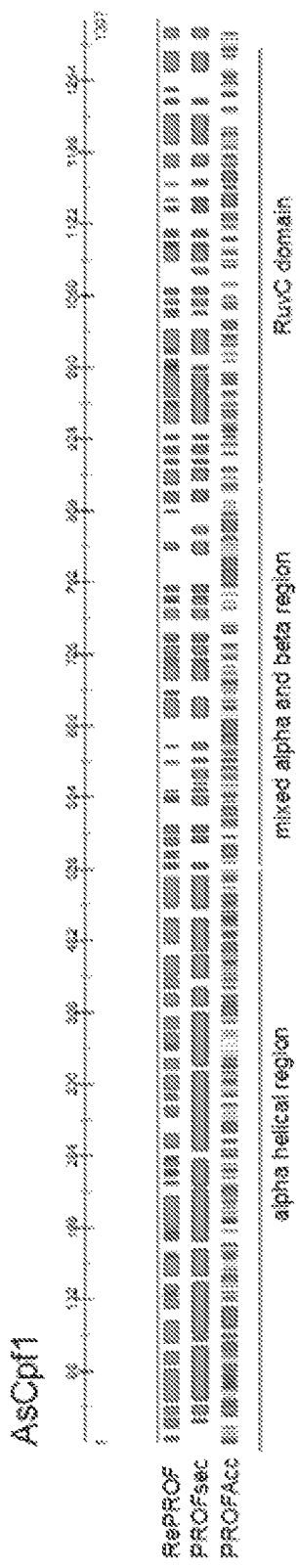
Figure 72C:
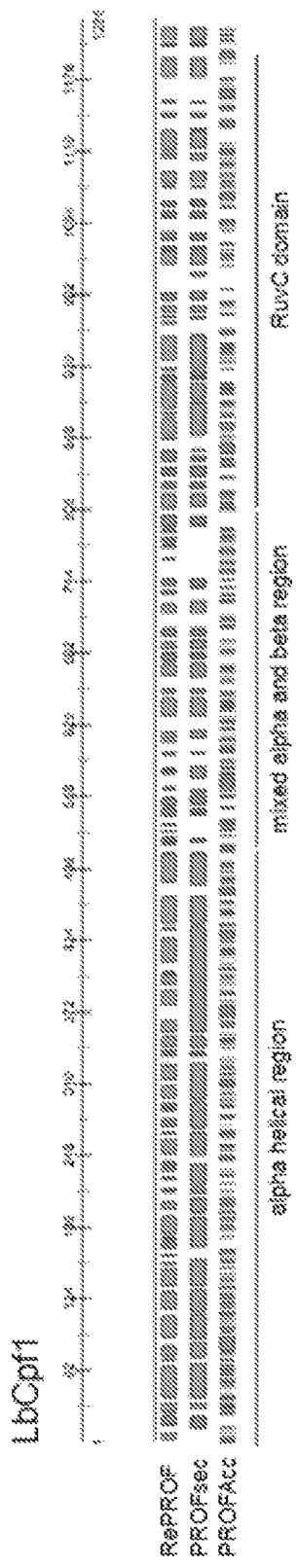

FIG. 72A-72C depicts a computational analysis of the primary structure of Cpf1 nucleases reveals three distinct regions. First a C-terminal RuvC like domain, which is the only functional characterized domain. Second a N-terminal alpha-helical region and thirst a mixed alpha and beta region, located between the RuvC like domain and the alpha-helical region.

Figure 73A:
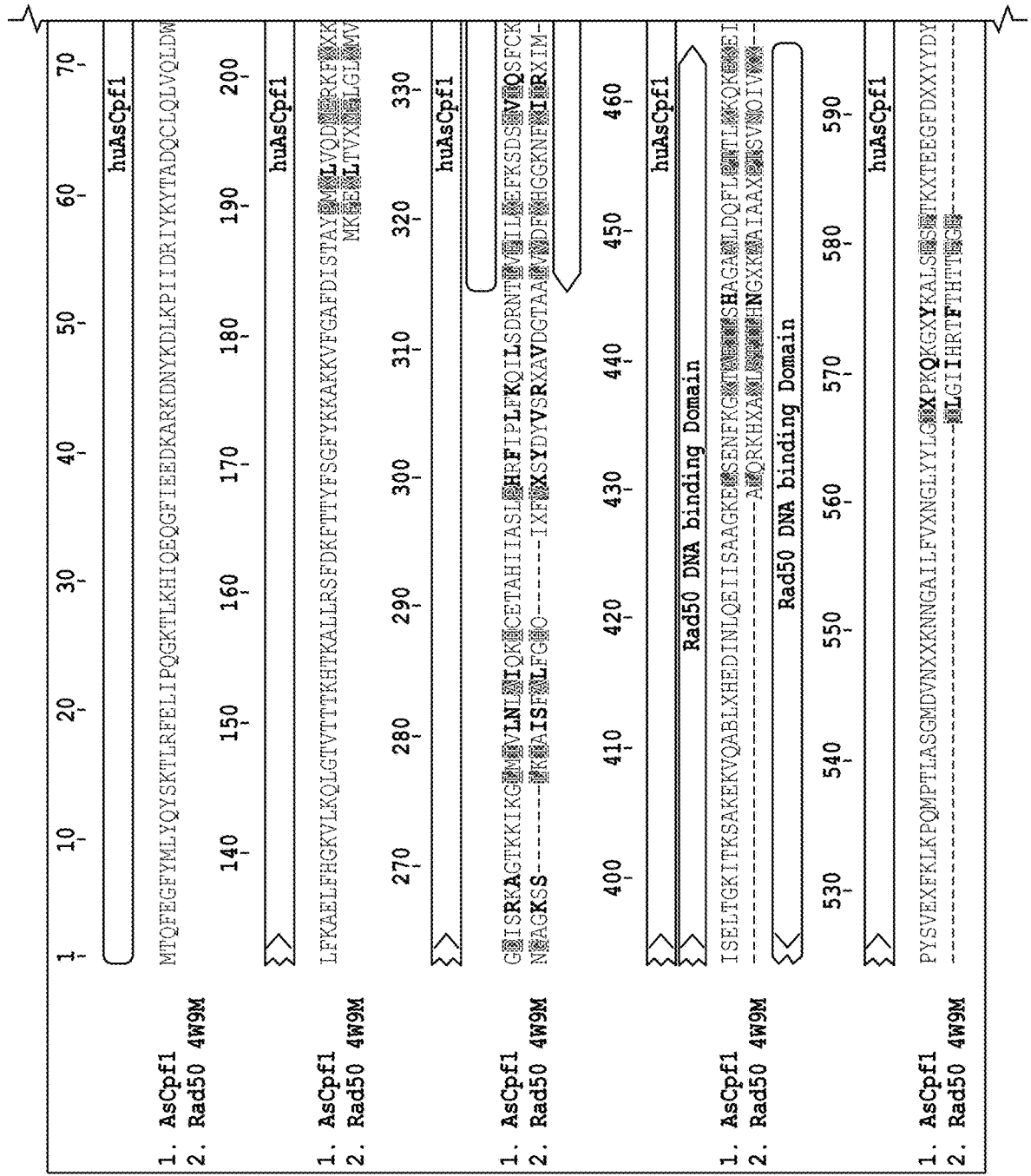
Figure 73B:
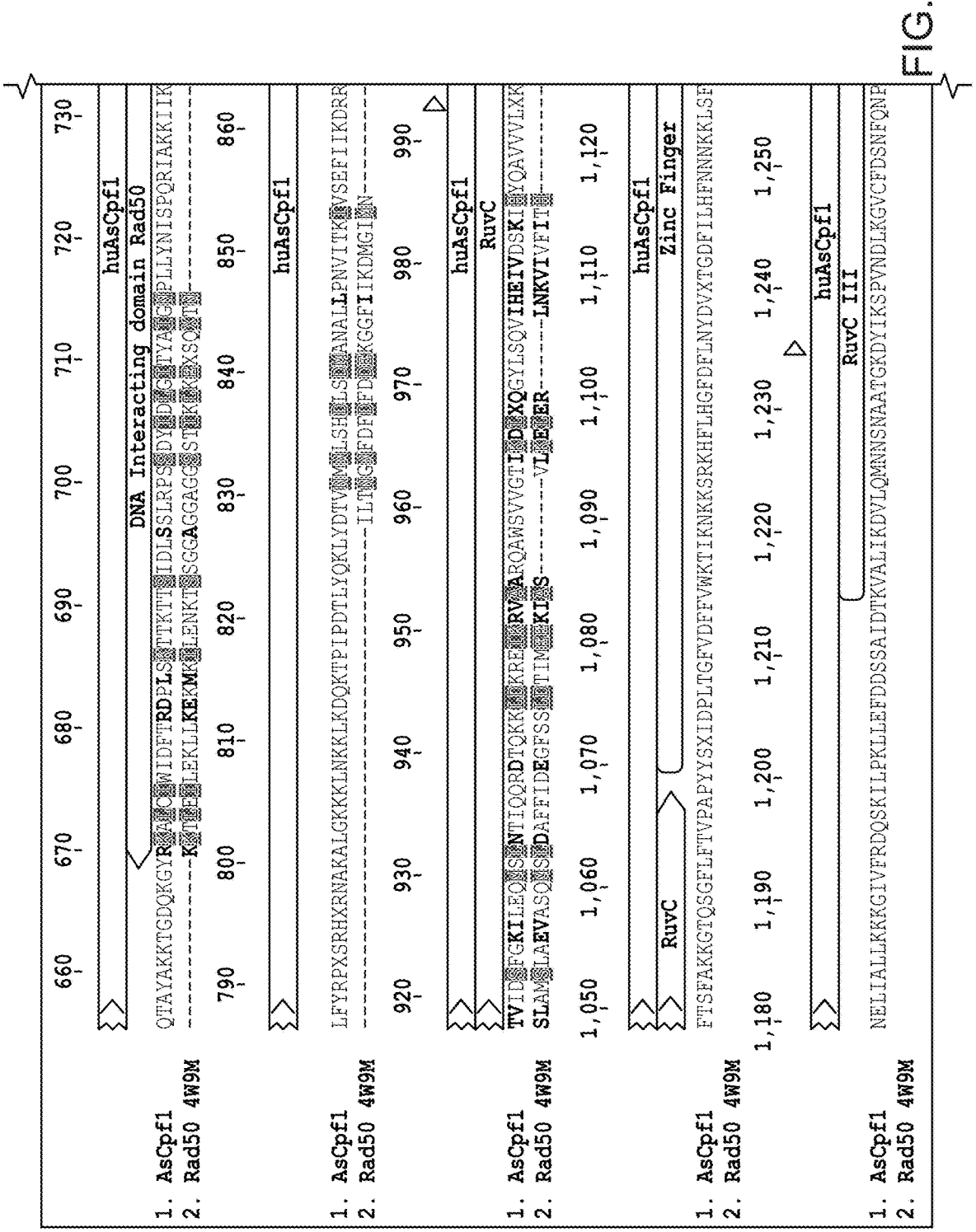

FIGS. 73A-73B depicts an AsCpf1 Rad50 alignment (PDB 4W9M). SEQ ID NOS 726 and 727, respectively, disclosed in order of appearance.

Figure 73C:
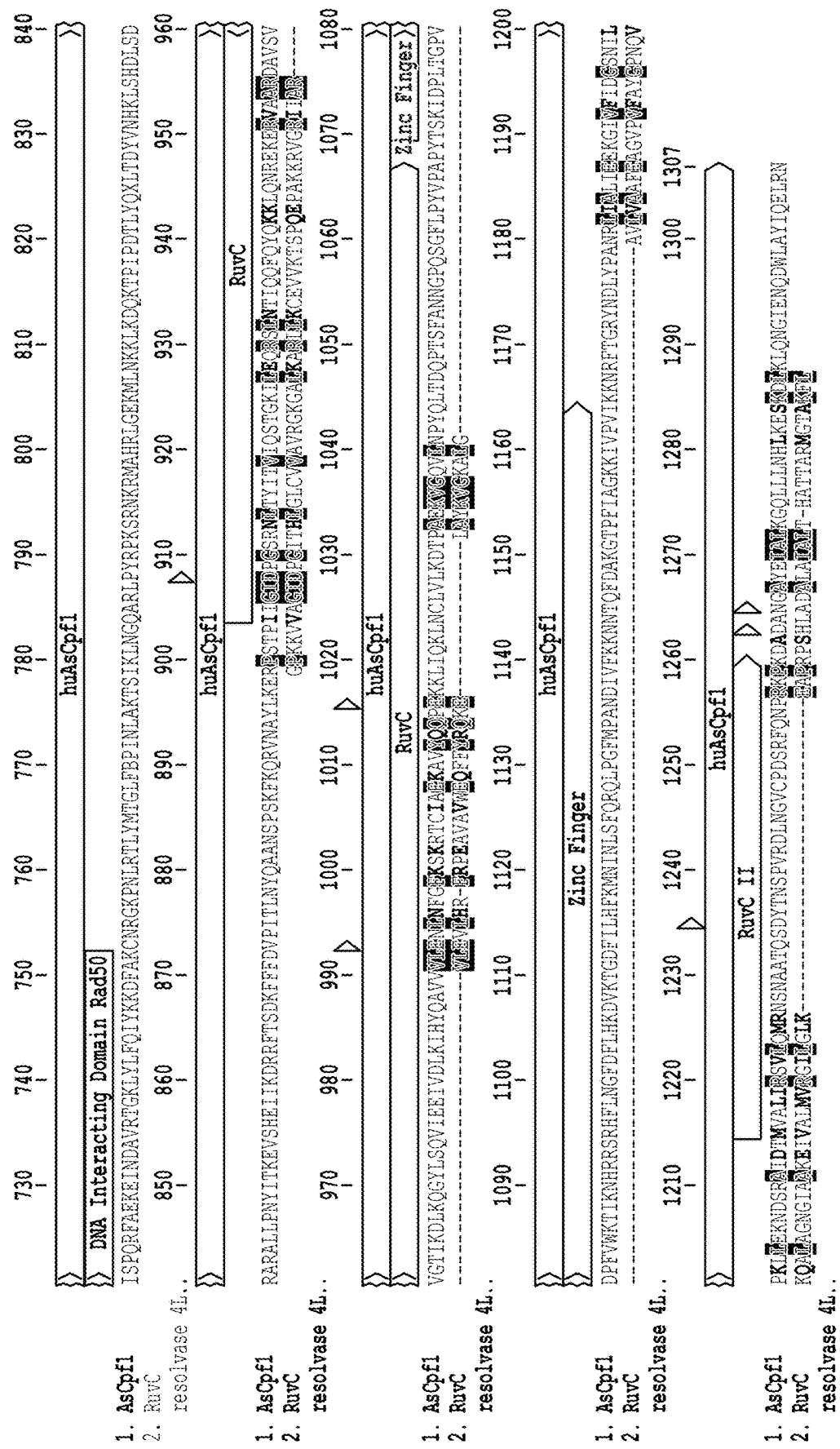

FIG. 73C depicts an AsCpf1 RuvC alignment (PDB 4LD0). SEQ ID NOS 728 and 729, respectively, disclosed in order of appearance.

FIGS. 73D-73E depicts an alignment of AsCpf1 and FnCpf1 which identifies Rad50 domain in FnCpf1. SEQ ID NOS 730 and 731, respectively, disclosed in order of appearance.

Figure 74:
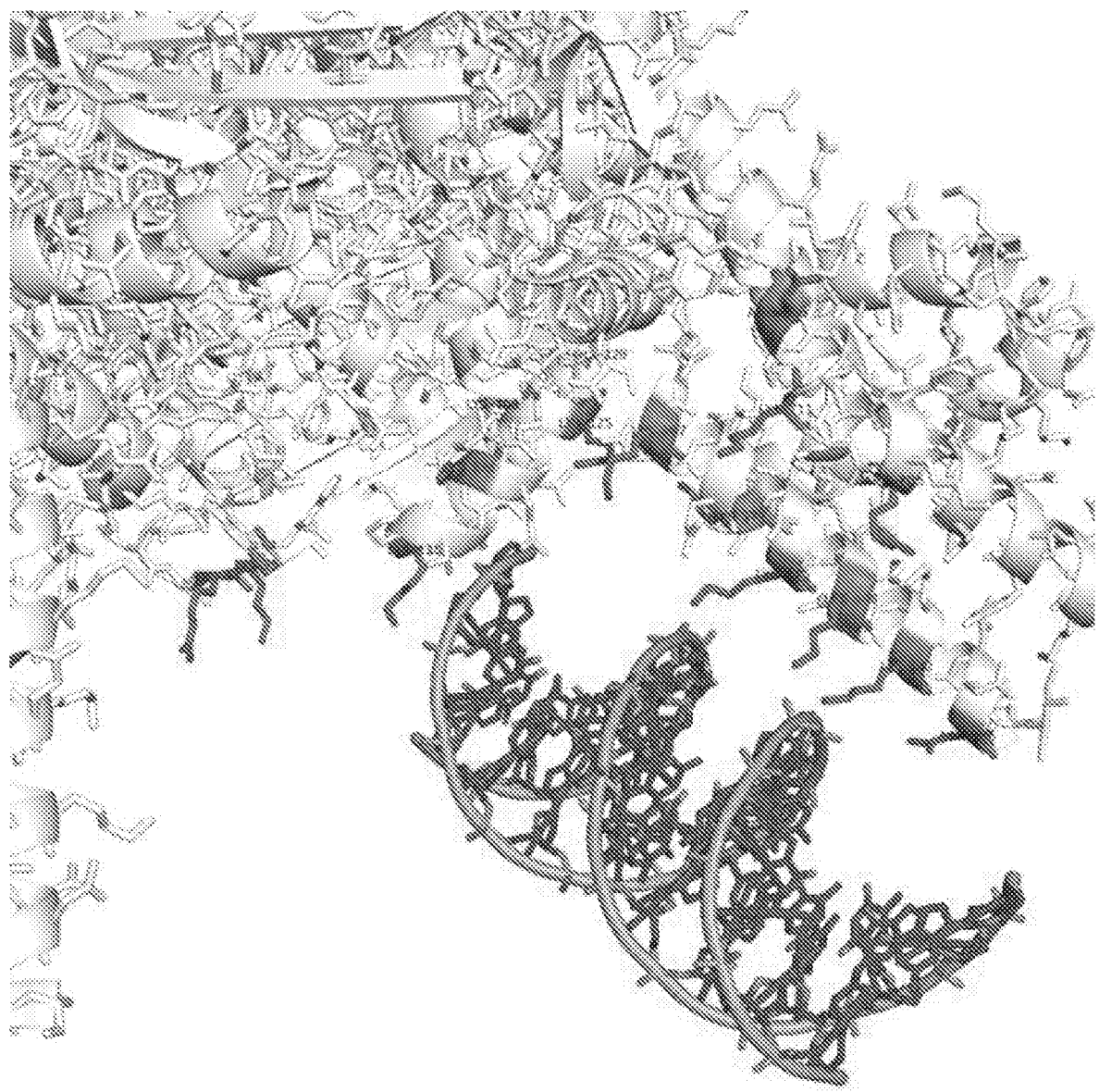

FIG. 74 depicts a structure of Rad50 (4W9M) in complex with DNA. DNA interacting residues are highlighted (in red).

Figure 75:
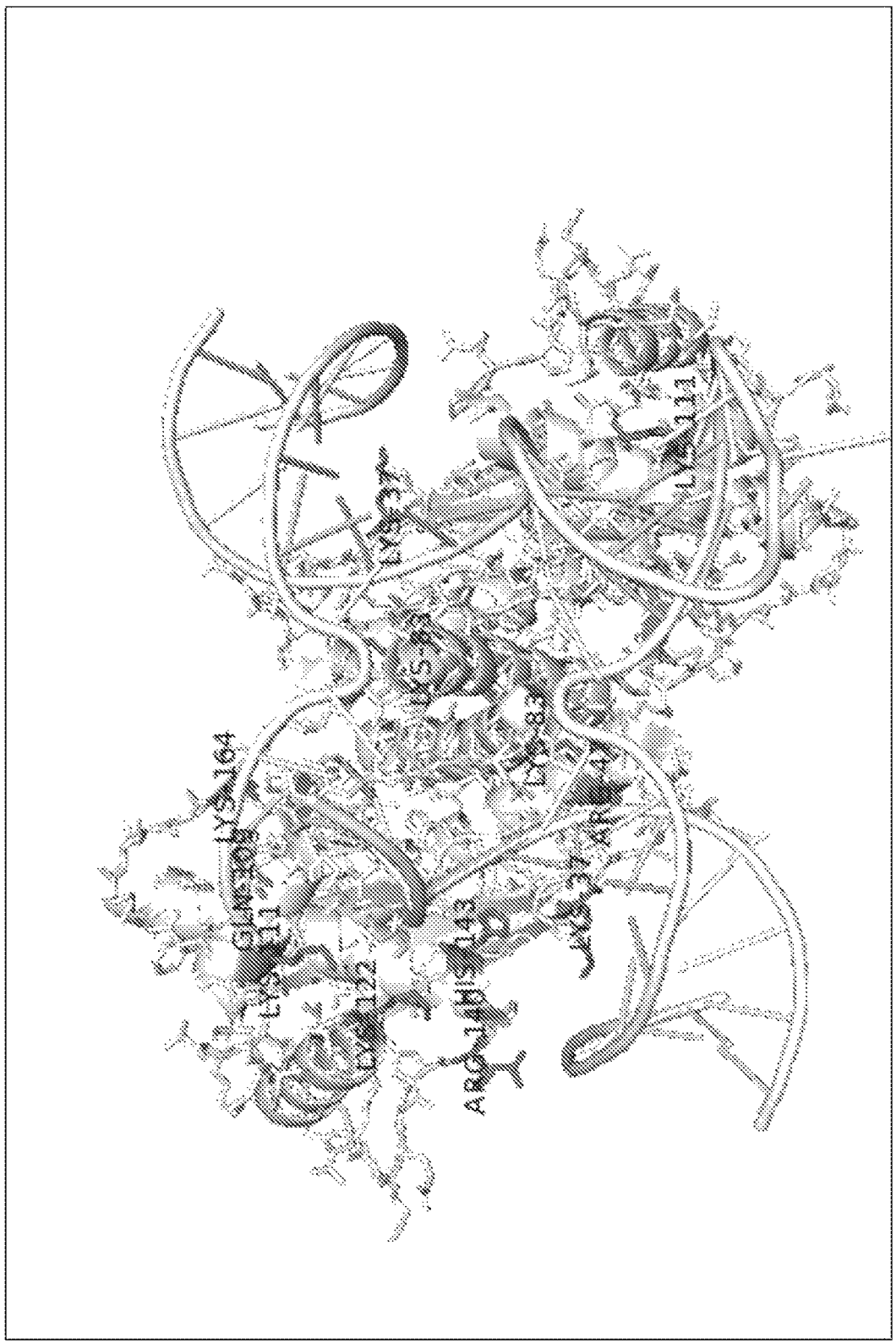

FIG. 75 depicts a structure of RuvC (4LD0) in complex with holiday junction. DNA interacting residues are highlighted in red.

FIG. 76 depicts a blast of AsCpf1 aligns to a region of the site specific recombinase XerD. An active site regions of XerD is LYWTGMR (SEQ ID NO: 1) with R being a catalytic residue. SEQ ID NOS 732-733, respectively, disclosed in order of appearance.

Figure 77:
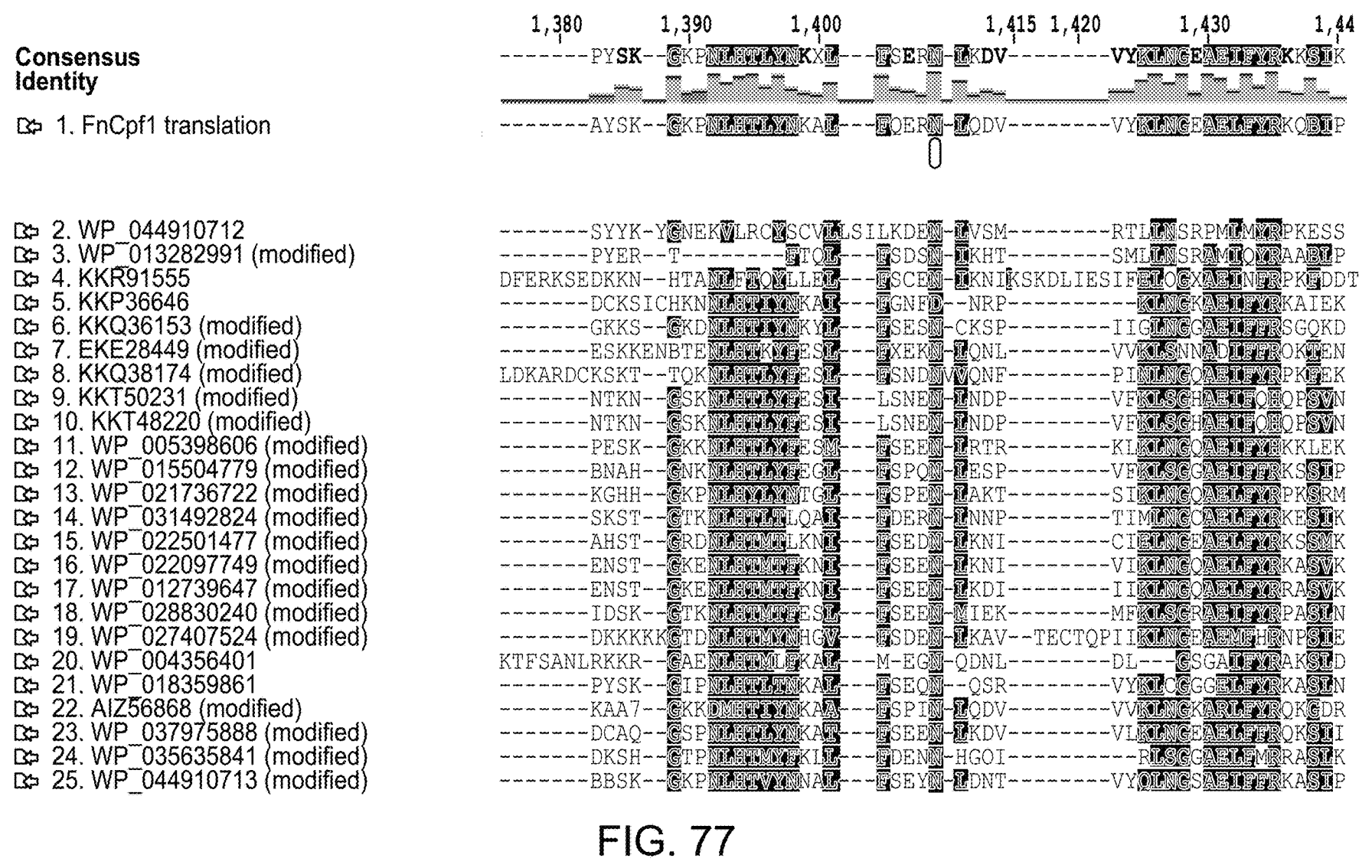
Figure 77:
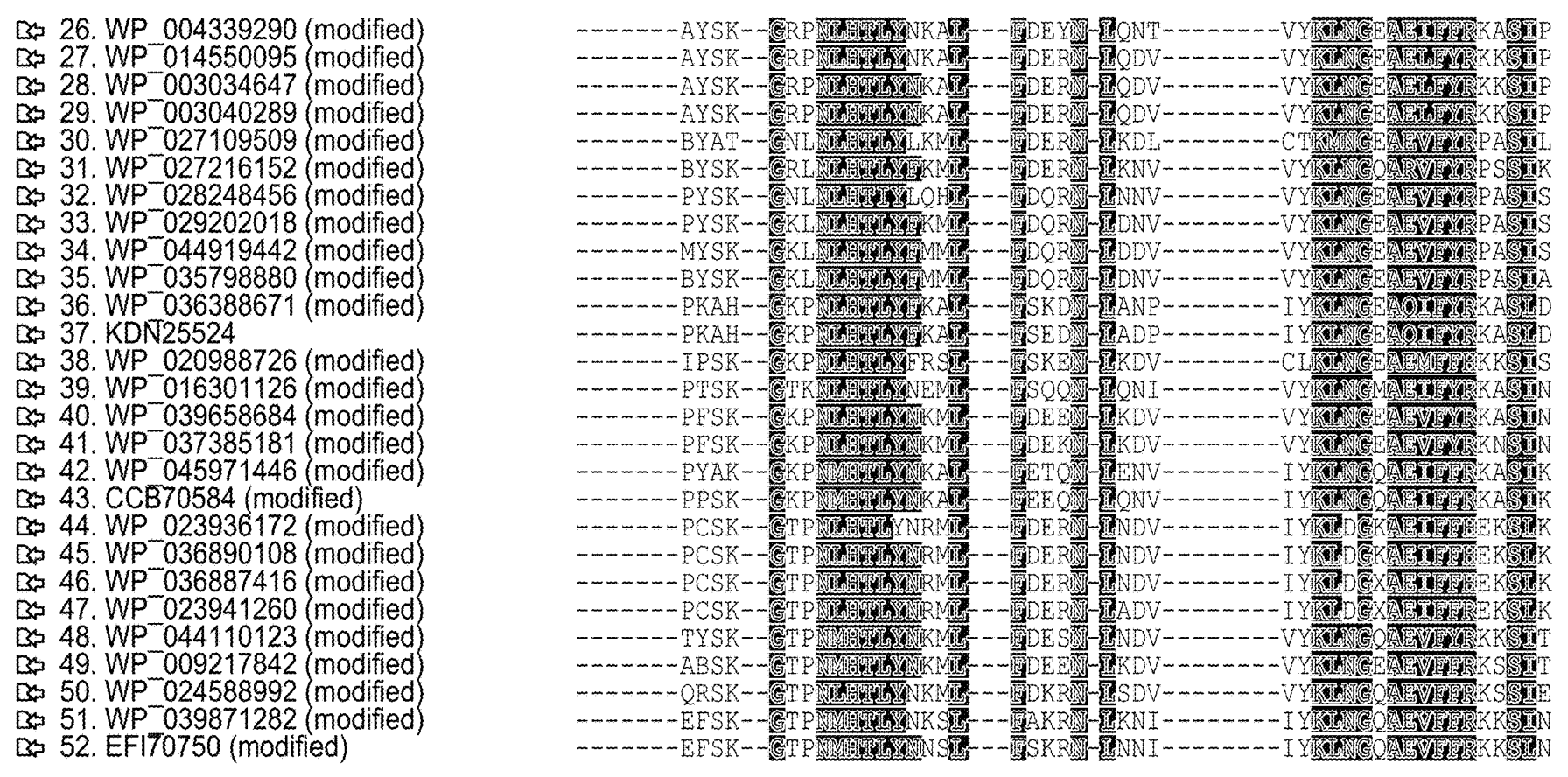

FIG. 77 depicts a region is conserved in Cpf1 orthologs (Yellow box) and although the R is not conserved, a highly conserved aspartic acid (orange box) is just C-terminal of this region and a nearby conserved region (blue box) with an absolutely conserved arginine. The aspartic acid is D732 in LbCpf1. SEQ ID NOS 734-786, respectively, disclosed in order of appearance.

Figure 78A:
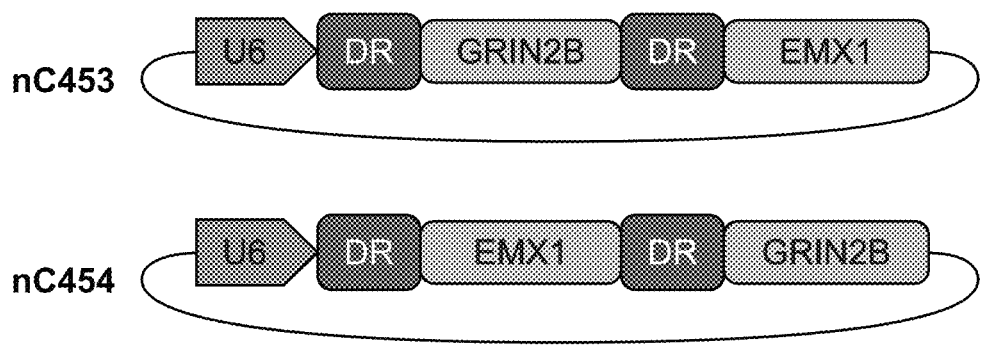

FIG. 78A shows an experiment where 150,000 HEK293T cells were plated per 24-well 24h before transfection. Cells were transfected with 400 ng huAsCpf1 plasmid and 100 ng of tandem guide plasmid comprising one guide sequence directed to GRIN28 and one directed to EMX1 placed in tandem behind the U6 promoter, using Lipofectamin2000. Cells were harvested 72h after transfection and AsCpf1 activity mediated by tandem guides was assayed using the SURVEYOR nuclease assay.

Figure 78B:
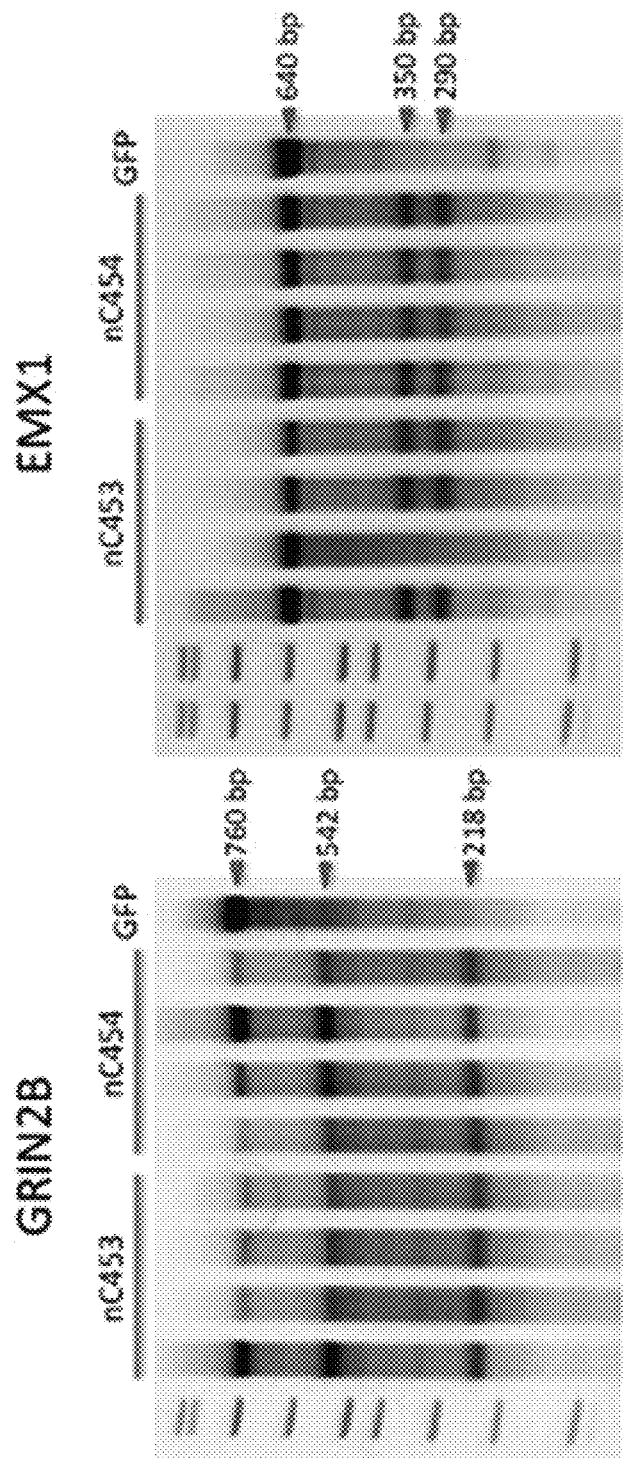

FIG. 78B demonstrates INDEL formation in both the GRIN28 and the EMX1 gene.

Figure 79:
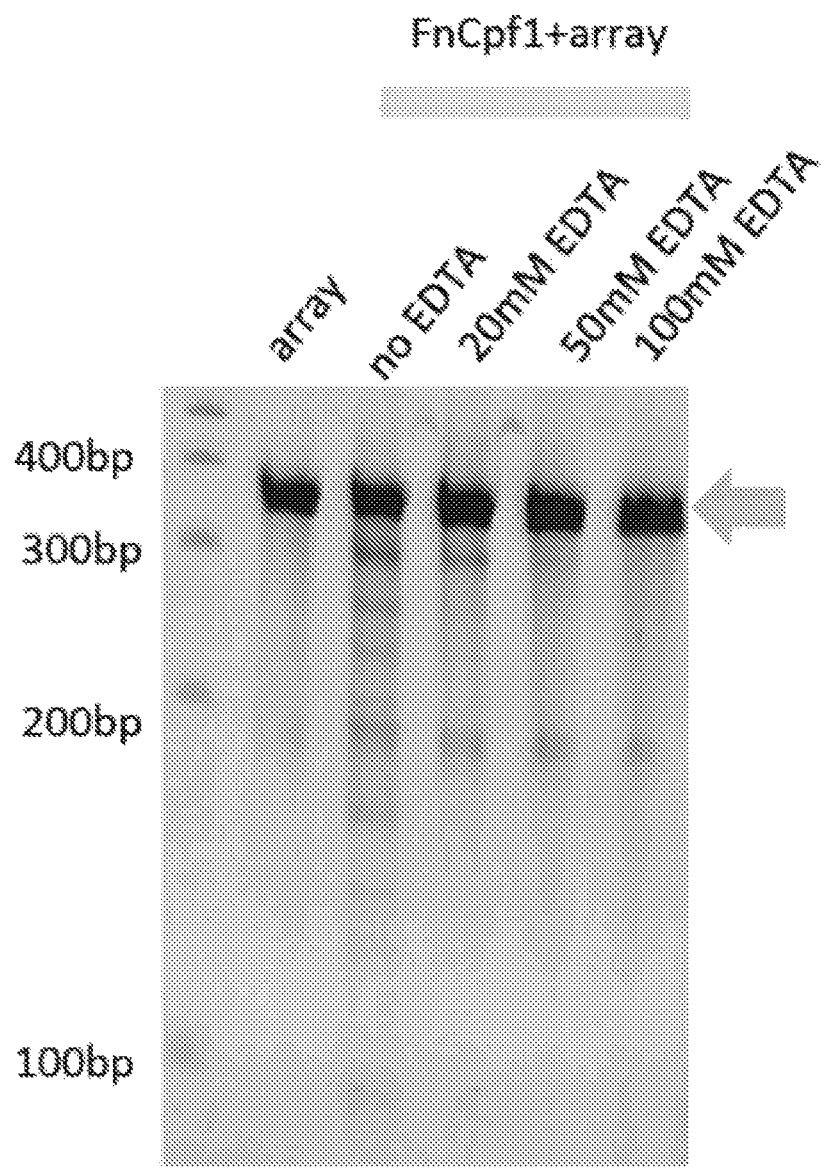

FIG. 79 shows FnCpf1 cleavage of an array with increasing concentrations of EDTA (and decreasing concentrations of Mg2+). The buffer is 20 mM TrisHCl pH 7 (room temperature), 50 mM KCl, and includes a murine RNAse inhibitor to prevent degradation of RNA due to potential trace amount of non-specific RNase carried over from protein purification.

FIG. 80 presents a schematic of sugar attachments for directed delivery of protein or guide, especially with GalNac.

Figure 81B:
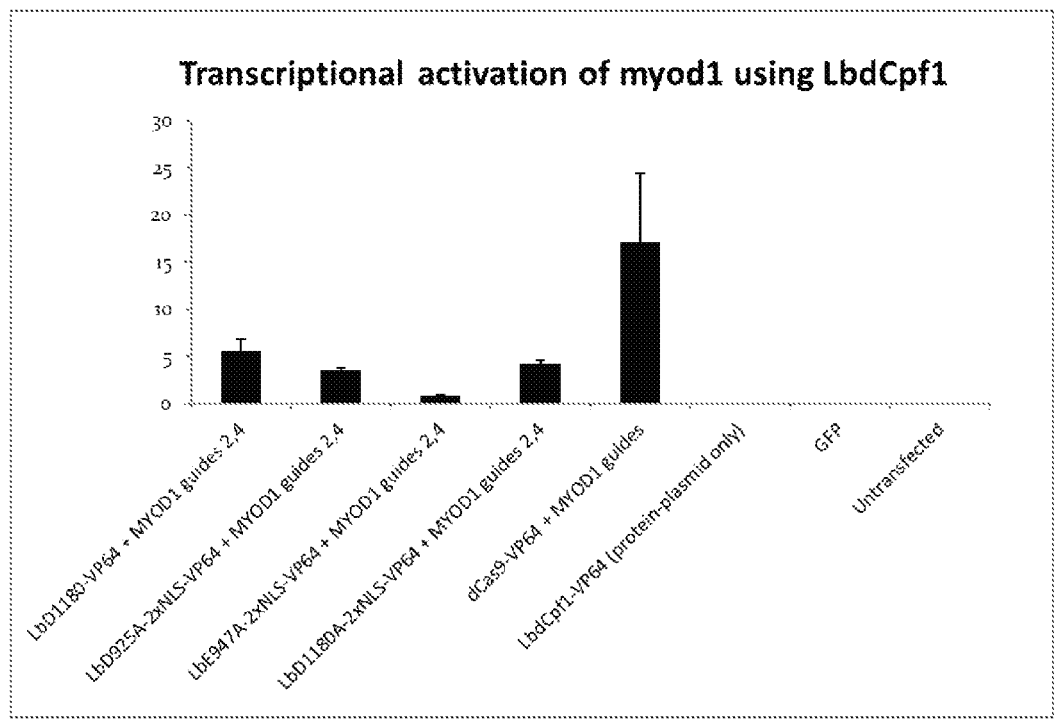

FIG. 81A-81B Transcriptional Activation of ASCL1 (A) or MYOD1 (B and C) using dCpf1-VP64. Results from qPCR readout of ASCL1 or MYOD1 transcripts from HEK293T cells transfected with indicated dCpf1-VP64 and guide constructs.

Figure 82:
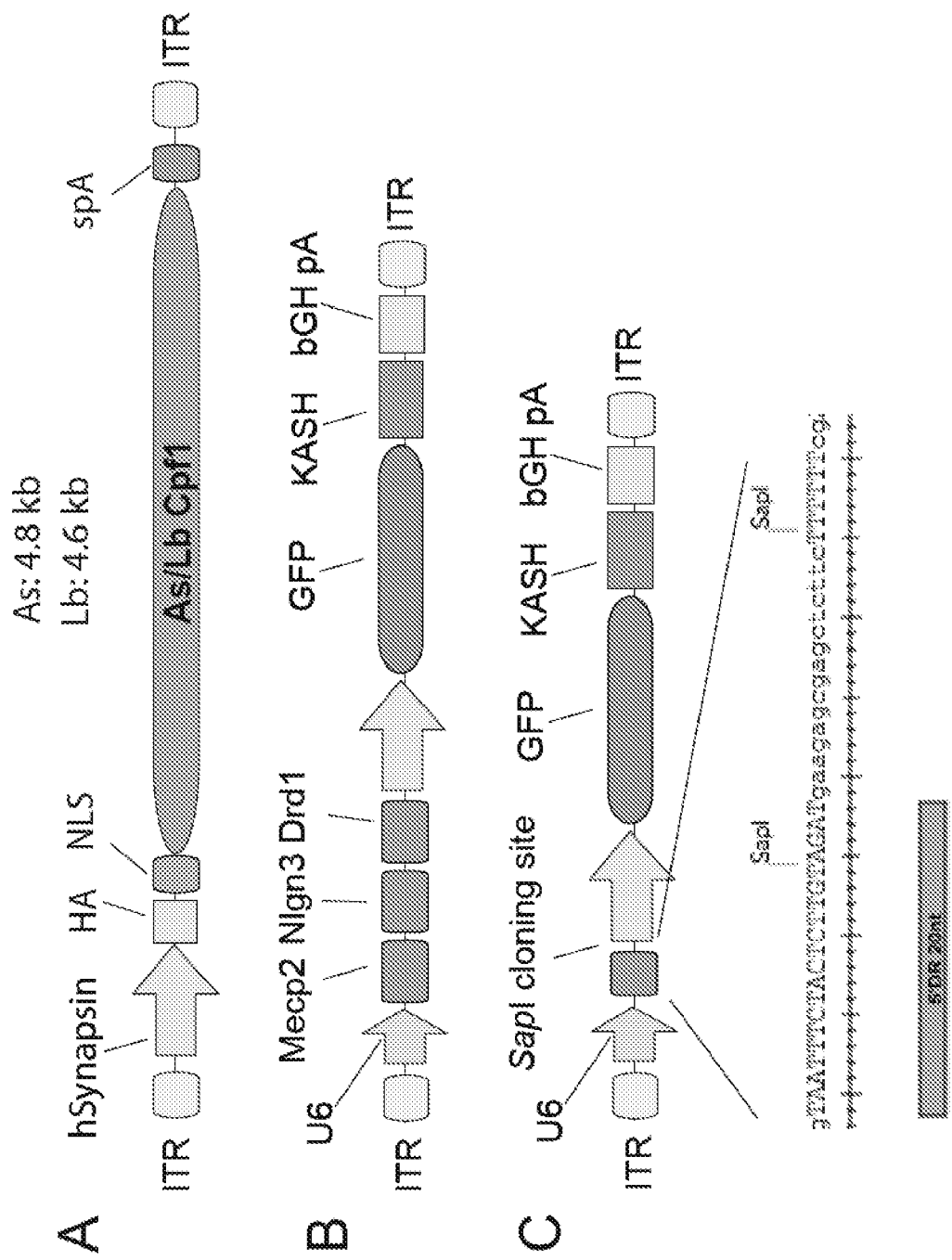

FIG. 82A-C: Construction of vectors for in vivo delivery. A. Cpf1 Vector; B: Gene blocks encoding for U6 promoter and three Cpf1 guide RNAs in tandem cloned into an AAV vector encoding for human Synapsin-GFP-KASH. C: vector for SapI cloning of annealed oligos (SEQ ID NO: 787).

Figure 83:
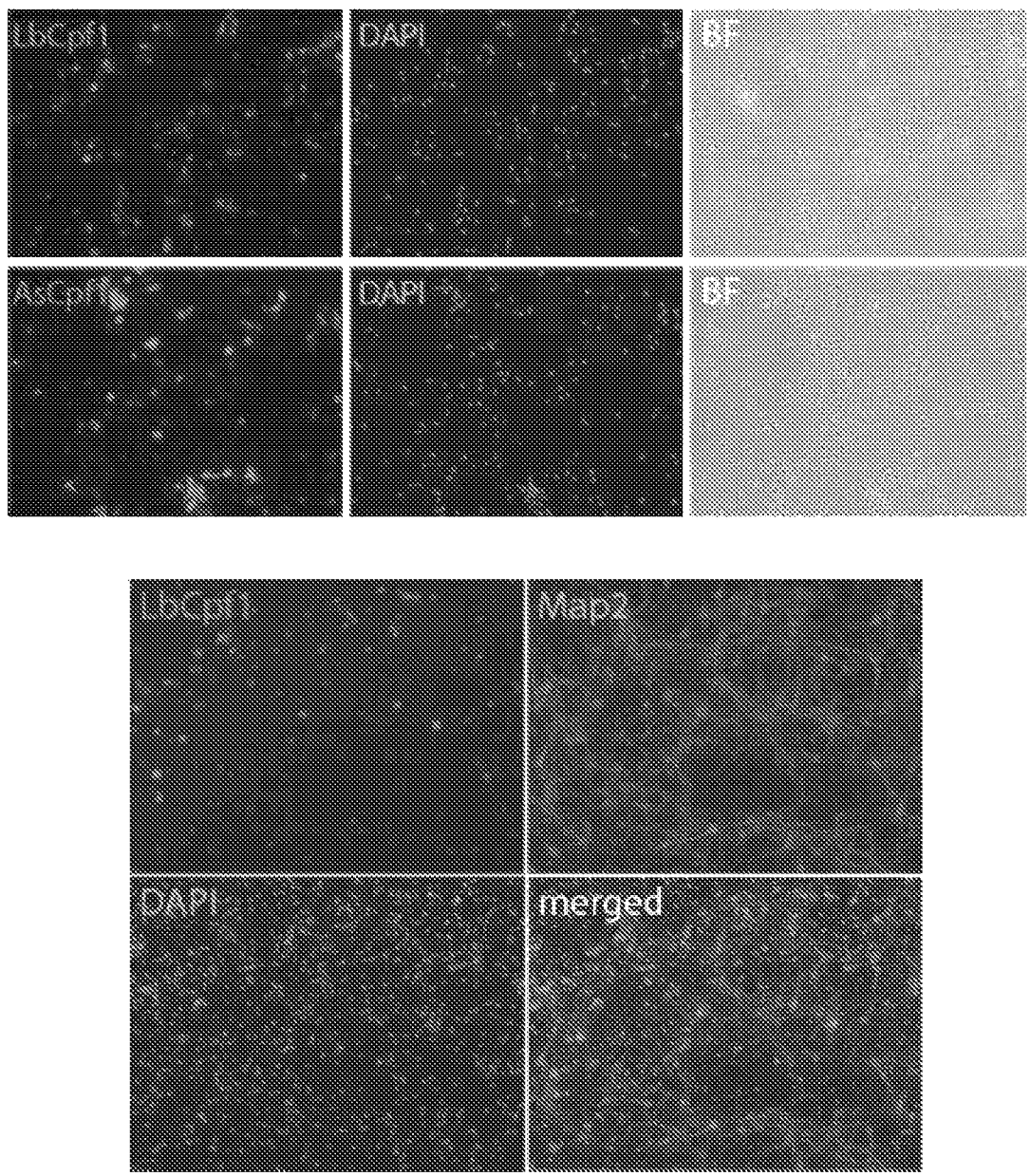

FIG. 83: Validation of delivery of Cpf1 construct: staining of neuronal cells with anti-HA.

Figure 84:
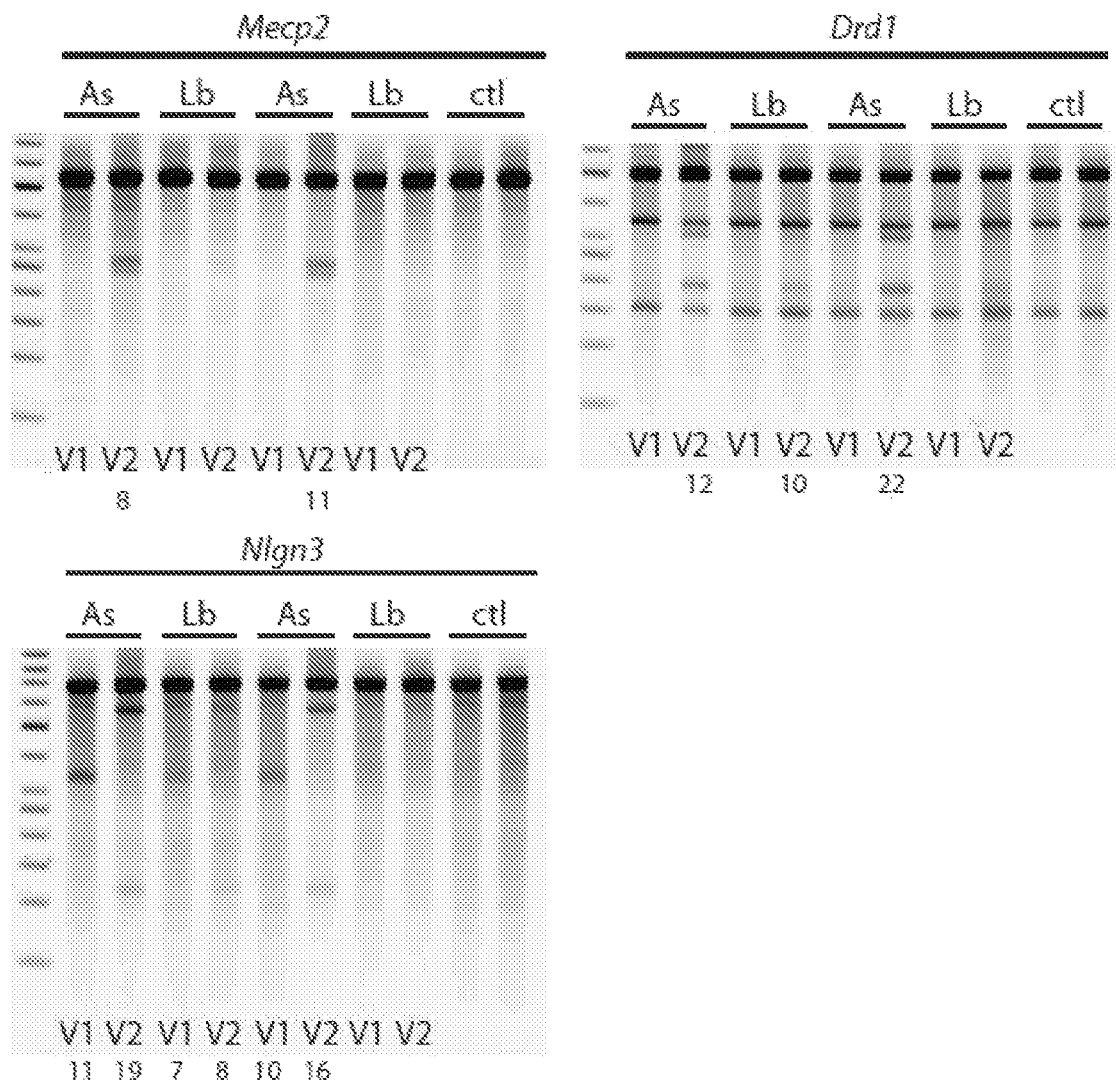

FIG. 84: Targeted cleavage of mouse genes Mecp2, Nlgn3, and Drd1 in HEK293FT cells.

Figure 85:
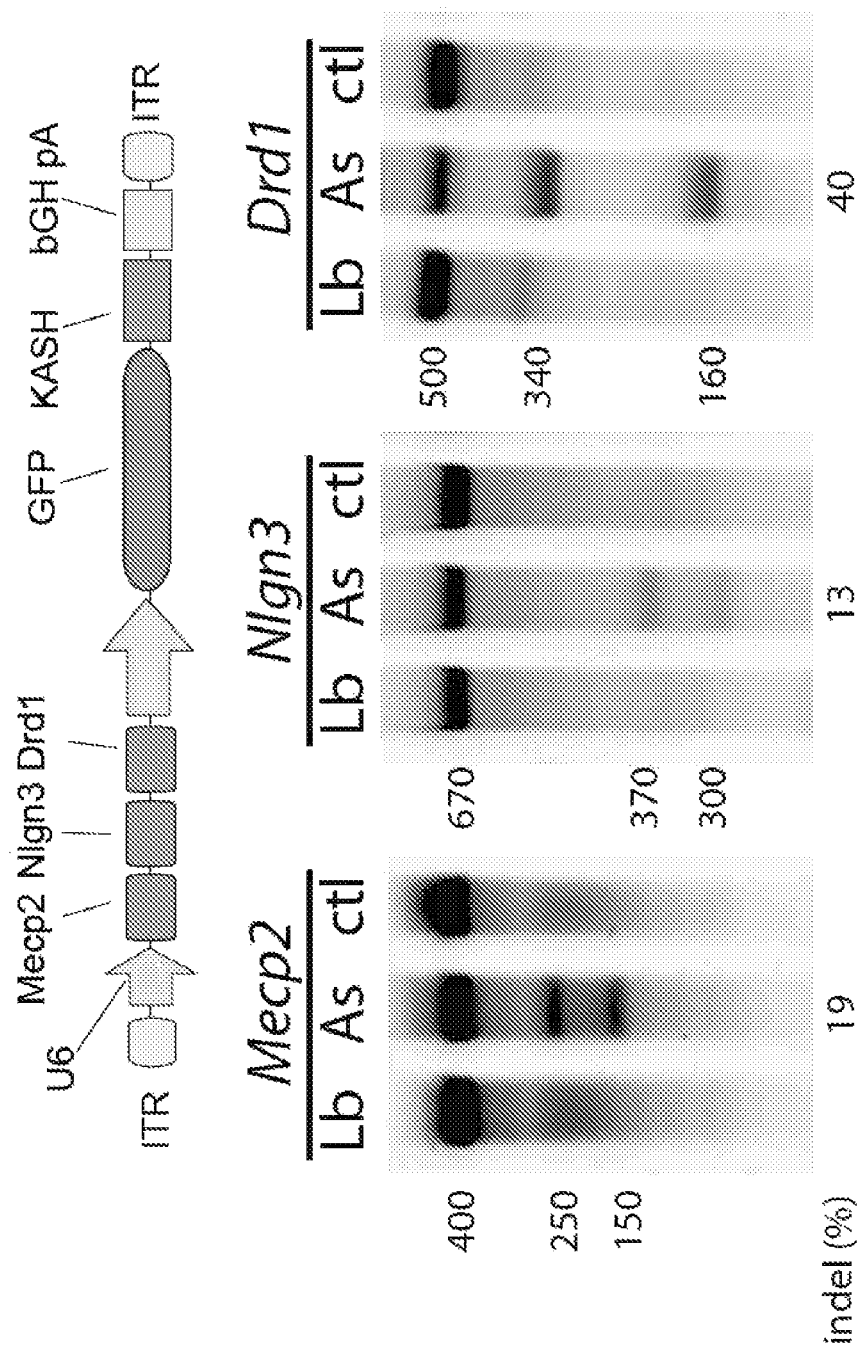

FIG. 85: Surveyor data for cleavage of Mecp2, Nlgn3, and Drd1 in Neuro-2a (N2a) cells and primary cortical neurons.

The figures herein are for illustrative purposes only and are not necessarily drawn to scale.

DETAILED DESCRIPTION OF THE INVENTION

The present application describes novel RNA-guided endonucleases (e.g. Cpf1 effector proteins) which are functionally distinct from the CRISPR-Cas9 systems described previously and hence the terminology of elements associated with these novel endonulceases are modified accordingly herein. Cpf1-associated CRISPR arrays described herein are processed into mature crRNAs without the requirement of an additional tracrRNA. The crRNAs described herein comprise a spacer sequence (or guide sequence) and a direct repeat sequence and a Cpf1p-crRNA complex by itself is sufficient to efficiently cleave target DNA. The seed sequence described herein, e.g. the seed sequence of a FnCpf1 guide RNA is approximately within the first 5 nt on the 5' end of the spacer sequence (or guide sequence) and mutations within the seed sequence adversely affect cleavage activity of the Cpf1 effector protein complex.

In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to target, e.g. have complementarity, where hybridization between a target sequence and a guide sequence promotes the formation of a CRISPR complex. The section of the guide sequence through which complementarity to the target sequence is important for cleavage activity is referred to herein as the seed sequence. A target sequence may comprise any polynucleotide, such as DNA polynucleotides and is comprised within a target locus of interest. In some embodiments, a target sequence is located in the nucleus or cytoplasm of a cell. The herein described invention encompasses novel effector proteins of Class 2 CRISPR-Cas systems, of which Cas9 is an exemplary effector protein and hence terms used in this application to describe novel effector proteins, may correlate to the terms used to describe the CRISPR-Cas9 system.

The CRISPR-Cas loci has more than 50 gene families and there is no strictly universal genes. Therefore, no single evolutionary tree is feasible and a multi-pronged approach is needed to identify new families. So far, there is comprehensive cas gene identification of 395 profiles for 93 Cas proteins. Classification includes signature gene profiles plus signatures of locus architecture. Aspects of the invention relate to the identification and engineering of novel effector proteins associated with Class 2 CRISPR-Cas systems. In a preferred embodiment, the effector protein comprises a single-subunit effector module. In a further embodiment the effector protein is functional in prokaryotic or eukaryotic cells for in vitro, in vivo or ex vivo applications. An aspect of the invention encompasses computational methods and algorithms to predict new Class 2 CRISPR-Cas systems and identify the components therein.

In one embodiment, a computational method of identifying novel Class 2 CRISPR-Cas loci comprises the following steps: detecting all contigs encoding the Cas1 protein; identifying all predicted protein coding genes within 20 kB of the cas1 gene; comparing the identified genes with Cas protein-specific profiles and predicting CRISPR arrays; selecting unclassified candidate CRISPR-Cas loci containing proteins larger than 500 amino acids (>500 aa); analyzing selected candidates using PSI-BLAST and HHPred, thereby isolating and identifying novel Class 2 CRISPR-Cas loci. In addition to the above mentioned steps, additional analysis of the candidates may be conducted by searching metagenomics databases for additional homologs.

In one aspect the detecting all contigs encoding the Cas1 protein is performed by GenemarkS which a gene prediction program as further described in "GeneMarkS: a self-training method for prediction of gene starts in microbial genomes. Implications for finding sequence motifs in regulatory regions." John Besemer, Alexandre Lomsadze and Mark Borodovsky, Nucleic Acids Research (2001) 29, pp 2607-2618, herein incorporated by reference.

In one aspect the identifying all predicted protein coding genes is carried out by comparing the identified genes with Cas protein-specific profiles and annotating them according to NCBI Conserved Domain Database (CDD) which is a protein annotation resource that consists of a collection of well-annotated multiple sequence alignment models for ancient domains and full-length proteins. These are available as position-specific score matrices (PSSMs) for fast identification of conserved domains in protein sequences via RPS-BLAST. CDD content includes NCBI-curated domains, which use 3D-structure information to explicitly define domain boundaries and provide insights into sequence/structure/function relationships, as well as domain models imported from a number of external source databases (Pfam, SMART, COG, PRK, TIGRFAM). In a further aspect, CRISPR arrays were predicted using a PILER-CR program which is a public domain software for finding CRISPR repeats as described in "PILER-CR: fast and accurate identification of CRISPR repeats", Edgar, R. C., BMC Bioinformatics, January 20; 8:18(2007), herein incorporated by reference.

In a further aspect, the case by case analysis is performed using PSI-BLAST (Position-Specific Iterative Basic Local Alignment Search Tool). PSI-BLAST derives a position-specific scoring matrix (PSSM) or profile from the multiple sequence alignment of sequences detected above a given score threshold using protein-protein BLAST. This PSSM is used to further search the database for new matches, and is updated for subsequent iterations with these newly detected sequences. Thus, PSI-BLAST provides a means of detecting distant relationships between proteins.

In another aspect, the case by case analysis is performed using HHpred, a method for sequence database searching and structure prediction that is as easy to use as BLAST or PSI-BLAST and that is at the same time much more sensitive in finding remote homologs. In fact, HHpred's sensitivity is competitive with the most powerful servers for structure prediction currently available. HHpred is the first server that is based on the pairwise comparison of profile hidden Markov models (HMMs). Whereas most conventional sequence search methods search sequence databases such as UniProt or the NR, HHpred searches alignment databases, like Pfam or SMART. This greatly simplifies the list of hits to a number of sequence families instead of a clutter of single sequences. All major publicly available profile and alignment databases are available through HHpred. HHpred accepts a single query sequence or a multiple alignment as input. Within only a few minutes it returns the search results in an easy-to-read format similar to that of PSI-BLAST. Search options include local or global alignment and scoring secondary structure similarity. HHpred can produce pairwise query-template sequence alignments, merged query-template multiple alignments (e.g. for transitive searches), as well as 3D structural models calculated by the MODELLER software from HHpred alignments. The term "nucleic acid-targeting system", wherein nucleic acid is DNA or RNA, and in some aspects may also refer to DNA-RNA hybrids or derivatives thereof, refers collectively to transcripts and other elements involved in the expression of or directing the activity of DNA or RNA-targeting CRISPR-associated ("Cas") genes, which may include sequences encoding a DNA or RNA-targeting Cas protein and a DNA or RNA-targeting guide RNA comprising a CRISPR RNA (crRNA) sequence and (in CRISPR-Cas9 system but not all systems) a trans-activating CRISPR-Cas system RNA (tracrRNA) sequence, or other sequences and transcripts from a DNA or RNA-targeting CRISPR locus. In the Cpf1 DNA targeting RNA-guided endonuclease systems described herein, a tracrRNA sequence is not required. In general, a RNA-targeting system is characterized by elements that promote the formation of a RNA-targeting complex at the site of a target RNA sequence. In the context of formation of a DNA or RNA-targeting complex, "target sequence" refers to a DNA or RNA sequence to which a DNA or RNA-targeting guide RNA is designed to have complementarity, where hybridization between a target sequence and a RNA-targeting guide RNA promotes the formation of a RNA-targeting complex. In some embodiments, a target sequence is located in the nucleus or cytoplasm of a cell.

In an aspect of the invention, novel DNA targeting systems also referred to as DNA-targeting CRISPR-Cas or the CRISPR-Cas DNA-targeting system of the present application are based on identified Type V (e.g. subtype V-A and subtype V-B) Cas proteins which do not require the generation of customized proteins to target specific DNA sequences but rather a single effector protein or enzyme can be programmed by a RNA molecule to recognize a specific DNA target, in other words the enzyme can be recruited to a specific DNA target using said RNA molecule. Aspects of the invention particularly relate to DNA targeting RNA-guided Cpf1 CRISPR systems.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing; trafficking of target nucleic acids, tracing of target nucleic acids, isolation of target nucleic acids, visualization of target nucleic acids, etc.

As used herein, a Cas protein or a CRISPR enzyme refers to any of the proteins presented in the new classification of CRISPR-Cas systems. In an advantageous embodiment, the present invention encompasses effector proteins identified in a Type V CRISPR-Cas loci, e.g. a Cpf1-encoding loci denoted as subtype V-A. Presently, the subtype V-A loci encompasses cas1, cas2, a distinct gene denoted cpf1 and a CRISPR array. Cpf1 (CRISPR-associated protein Cpf1, subtype PREFRAN) is a large protein (about 1300 amino acids) that contains a RuvC-like nuclease domain homologous to the corresponding domain of Cas9 along with a counterpart to the characteristic arginine-rich cluster of Cas9. However, Cpf1 lacks the HNH nuclease domain that is present in all Cas9 proteins, and the RuvC-like domain is contiguous in the Cpf1 sequence, in contrast to Cas9 where it contains long inserts including the HNH domain. Accordingly, in particular embodiments, the CRISPR-Cas enzyme comprises only a RuvC-like nuclease domain.

The Cpf1 gene is found in several diverse bacterial genomes, typically in the same locus with cas1, cas2, and cas4 genes and a CRISPR cassette (for example, FNFX1_1431-FNFX1_1428 of *Francisella* cf. *novicida* Fx1). Thus, the layout of this putative novel CRISPR-Cas system appears to be similar to that of type II-B. Furthermore, similar to Cas9, the Cpf1 protein contains a readily identifiable C-terminal region that is homologous to the transposon ORF-B and includes an active RuvC-like nuclease, an arginine-rich region, and a Zn finger (absent in Cas9). However, unlike Cas9, Cpf1 is also present in several genomes without a CRISPR-Cas context and its relatively high similarity with ORF-B suggests that it might be a transposon component. It was suggested that if this was a genuine CRISPR-Cas system and Cpf1 is a functional analog of Cas9 it would be a novel CRISPR-Cas type, namely type V (See Annotation and Classification of CRISPR-Cas Systems. Makarova K S, Koonin E V. Methods Mol Biol. 2015; 1311:47-75). However, as described herein, Cpf1 is denoted to be in subtype V-A to distinguish it from C2c1p which does not have an identical domain structure and is hence denoted to be in subtype V-B.

Aspects of the invention also encompass methods and uses of the compositions and systems described herein in genome engineering, e.g. for altering or manipulating the expression of one or more genes or the one or more gene products, in prokaryotic or eukaryotic cells, in vitro, in vivo or ex vivo.

In embodiments of the invention the terms mature crRNA and guide RNA and single guide RNA are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at worldwideweb.novocraft.com), ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence may be selected to target any target sequence. In some embodiments, the target sequence is a sequence within a genome of a cell. Exemplary target sequences include those that are unique in the target genome.

In certain aspects the invention involves vectors. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1a promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Advantageous vectors include lentiviruses and adeno-associated viruses, and types of such vectors can also be selected for targeting particular types of cells.

As used herein, the term "crRNA" or "guide RNA" or "single guide RNA" or "sgRNA" or "one or more nucleic acid components" of a Type V CRISPR-Cas locus effector protein comprises any polynucleotide sequence having sufficient complementarity with a target nucleic acid sequence to hybridize with the target nucleic acid sequence and direct sequence-specific binding of a nucleic acid-targeting complex to the target nucleic acid sequence. In embodiments of the invention the terms mature crRNA and guide RNA and single guide RNA are used interchangeably as in foregoing cited documents such as WO 2014/093622 (PCT/US2013/074667). In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at worldwideweb.novocraft.com), ELAND (Illumina, San Diego, CA), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence (or a sequence in the vicinity thereof) may be evaluated in a test tube by providing the target nucleic acid sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art. A guide sequence, and hence a nucleic acid-targeting guide RNA may be selected to target any target nucleic acid sequence. The target sequence may be DNA. In some embodiments, the target sequence is a sequence within a genome of a cell. Exemplary target sequences include those that are unique in the target genome.

In some embodiments, a nucleic acid-targeting guide RNA is selected to reduce the degree secondary structure within the RNA-targeting guide RNA. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and P A Carr and G M Church, 2009, Nature Biotechnology 27(12): 1151-62).

The "tracrRNA" sequence or analogous terms includes any polynucleotide sequence that has sufficient complementarity with a crRNA sequence to hybridize. As indicated herein above, in embodiments of the present invention, the tracrRNA is not required for cleavage activity of Cpf1 effector protein complexes.

Applicants also perform a challenge experiment to verify the DNA targeting and cleaving capability of a Type V protein such as Cpf1. This experiment closely parallels similar work in *E. coli* for the heterologous expression of StCas9 (Sapranauskas, R. et al. Nucleic Acids Res 39, 9275-9282 (2011)). Applicants introduce a plasmid containing both a PAM and a resistance gene into the heterologous *E. coli*, and then plate on the corresponding antibiotic. If there is DNA cleavage of the plasmid, Applicants observe no viable colonies.

In further detail, the assay is as follows for a DNA target. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the DNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12h after transformation, all colonies formed by the test and control strains where harvested and plasmid DNA was isolated. Plasmid DNA was used as template for PCR amplification and subsequent deep sequencing. Representation of all PAMs in the untransfomed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM.

For minimization of toxicity and off-target effect, it will be important to control the concentration of nucleic acid-targeting guide RNA delivered. Optimal concentrations of nucleic acid-targeting guide RNA can be determined by testing different concentrations in a cellular or non-human eukaryote animal model and using deep sequencing the analyze the extent of modification at potential off-target genomic loci. The concentration that gives the highest level of on-target modification while minimizing the level of off-target modification should be chosen for in vivo delivery. The nucleic acid-targeting system is derived advantageously from a Type V CRISPR system. In some embodiments, one or more elements of a nucleic acid-targeting system is derived from a particular organism comprising an endogenous RNA-targeting system. In preferred embodiments of the invention, the RNA-targeting system is a Type V CRISPR system. In particular embodiments, the Type V RNA-targeting Cas enzyme is Cpf1. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related. Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22(4):359-66. doi: 10.1002/pro.2225.). See also Shmakov et al. (2015) for application in the field of CRISPR-Cas loci. Homologous proteins may but need not be structurally related, or are only partially structurally related. In particular embodiments, the homologue or orthologue of Cpf1 as referred to herein has a sequence homology or identity of at least 80%, more preferably at least 85%, even more preferably at least 90%, such as for instance at least 95% with Cpf1. In further embodiments, the homologue or orthologue of Cpf1 as referred to herein has a sequence identity of at least 80%, more preferably at least 85%, even more preferably at least 90%, such as for instance at least 95% with the wild type Cpf1. Where the Cpf1 has one or more mutations (mutated), the homologue or orthologue of said Cpf1 as referred to herein has a sequence identity of at least 80%, more preferably at least 85%, even more preferably at least 90%, such as for instance at least 95% with the mutated Cpf1.

In an embodiment, the Type V DNA-targeting Cas protein may be a Cpf1 ortholog of an organism of a genus which includes but is not limited to Corynebacter, Sutterella, *Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. Species of organism of such a genus can be as otherwise herein discussed.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of organisms of a genus which includes but is not limited to *Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. A chimeric enzyme can comprise a first fragment and a second fragment, and the fragments can be of CRISPR enzyme orthologs of organisms of genuses herein mentioned or of species herein mentioned; advantageously the fragments are from CRISPR enzyme orthologs of different species.

In embodiments, the Type V DNA-targeting effector protein, in particular the Cpf1 protein as referred to herein also encompasses a functional variant of Cpf1 or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. Advantageous embodiments can involve engineered or non-naturally occurring Type V DNA-targeting effector protein, e.g., Cpf1 or an ortholog or homolog thereof.

In an embodiment, nucleic acid molecule(s) encoding the Type V DNA-targeting effector protein, in particular Cpf1 or an ortholog or homolog thereof, may be codon-optimized for expression in a eukaryotic cell. A eukaryote can be as herein discussed. Nucleic acid molecule(s) can be engineered or non-naturally occurring.

In an embodiment, the Type V DNA-targeting effector protein, in particular Cpf1 or an ortholog or homolog thereof, may comprise one or more mutations (and hence nucleic acid molecule(s) coding for same may have mutation(s)). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the Type V protein such as Cpf1 or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In some embodiments, the unmodified nucleic acid-targeting effector protein may have cleavage activity. In some embodiments, the DNA-targeting effector protein may direct cleavage of one or both nucleic acid (DNA or RNA) strands at the location of or near a target sequence, such as within the target sequence and/or within the complement of the target sequence or at sequences associated with the target sequence. In some embodiments, the nucleic acid-targeting effector protein may direct cleavage of one or both DNA or RNA strands within about 1, 2, 3, 4, 5, 6, 7, 8, 9, 10, 15, 20, 25, 50, 100, 200, 500, or more base pairs from the first or last nucleotide of a target sequence. In some embodiments, the cleavage may be staggered, i.e. generating sticky ends. In some embodiments, the cleavage is a staggered cut with a 5' overhang. In some embodiments, the cleavage is a staggered cut with a 5' overhang of 1 to 5 nucleotides, preferably of 4 or 5 nucleotides. In some embodiments, the cleavage site is distant from the PAM, e.g., the cleavage occurs after the $18^{th}$ nucleotide on the non-target strand and after the $23^{rd}$ nucleotide on the targeted strand (FIG. 60A). In some embodiments, the cleavage site occurs after the $18^{th}$ nucleotide (counted from the PAM) on the non-target strand and after the $23^{rd}$ nucleotide (counted from the PAM) on the targeted strand (FIG. 60A). In some embodiments, a vector encodes a nucleic acid-targeting effector protein that may be mutated with respect to a corresponding wild-type enzyme such that the mutated nucleic acid-targeting effector protein lacks the ability to cleave one or both DNA or RNA strands of a target polynucleotide containing a target sequence. As a further example, two or more catalytic domains of a Cas protein (e.g. RuvC I, RuvC II, and RuvC III or the HNH domain of a Cas9 protein) may be mutated to produce a mutated Cas protein substantially lacking all DNA cleavage activity. As described herein, corresponding catalytic domains of a Cpf1 effector protein may also be mutated to produce a mutated Cpf1 effector protein lacking all DNA cleavage activity or having substantially reduced DNA cleavage activity. In some embodiments, a nucleic acid-targeting effector protein may be considered to substantially lack all RNA cleavage activity when the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. An effector protein may be identified with reference to the general class of enzymes that share homology to the biggest nuclease with multiple nuclease domains from the Type V CRISPR system. Most preferably, the effector protein is a Type V protein such as Cpf1. By derived, Applicants mean that the derived enzyme is largely based, in the sense of having a high degree of sequence homology with, a wildtype enzyme, but that it has been mutated (modified) in some way as known in the art or as described herein.

Again, it will be appreciated that the terms Cas and CRISPR enzyme and CRISPR protein and Cas protein are generally used interchangeably and at all points of reference herein refer by analogy to novel CRISPR effector proteins further described in this application, unless otherwise apparent, such as by specific reference to Cas9. As mentioned above, many of the residue numberings used herein refer to the effector protein from the Type V CRISPR locus. However, it will be appreciated that this invention includes many more effector proteins from other species of microbes. In certain embodiments, effector proteins may be constitutively present or inducibly present or conditionally present or administered or delivered. Effector protein optimization may be used to enhance function or to develop new functions, one can generate chimeric effector proteins. And as described herein effector proteins may be modified to be used as a generic nucleic acid binding proteins.

Typically, in the context of a nucleic acid-targeting system, formation of a nucleic acid-targeting complex (comprising a guide RNA hybridized to a target sequence and complexed with one or more nucleic acid-targeting effector proteins) results in cleavage of one or both DNA strands in or near (e.g., within 1, 2, 3, 4, 5, 6, 7, 8, 9, 10, 20, 50, or more base pairs from) the target sequence. As used herein the term "sequence(s) associated with a target locus of interest" refers to sequences near the vicinity of the target sequence (e.g. within 1, 2, 3, 4, 5, 6, 7, 8, 9, 10, 20, 50, or more base pairs from the target sequence, wherein the target sequence is comprised within a target locus of interest).

An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., Cpf1) is within the ambit of the skilled artisan). Whilst this is preferred, it will be appreciated that other examples are possible and codon optimization for a host species other than human, or for codon optimization for specific organs is known. In some embodiments, an enzyme coding sequence encoding a DNA/RNA-targeting Cas protein is codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at worldwideweb.kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid. As to codon usage in yeast, reference is made to the online Yeast Genome database available at worldwideweb.yeastgenome.org/community/codon_usage.shtml, or Codon selection in yeast, Bennetzen and Hall, J Biol Chem. 1982 Mar. 25; 257(6):3026-31. As to codon usage in plants including algae, reference is made to *Codon usage in higher plants, green algae, and cyanobacteria*, Campbell and Gowri, Plant Physiol. 1990 January; 92(1): 1-11; as well as Codon usage in plant genes, Murray et al, Nucleic Acids Res. 1989 Jan. 25; 17(2):477-98; or *Selection on the codon bias of chloroplast and cyanelle genes in different plant and algal lineages*, Morton B R, J Mol Evol. 1998 April; 46(4):449-59.

In some embodiments, a vector encodes a nucleic acid-targeting effector protein such as the Type V DNA-targeting effector protein, in particular Cpf1 or an ortholog or homolog thereof comprising one or more nuclear localization sequences (NLSs), such as about or more than about 1, 2, 3, 4, 5, 6, 7, 8, 9, 10, or more NLSs. In some embodiments, the RNA-targeting effector protein comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 2); the NLS from nucleoplasmin (e.g., the nucleoplasmin bipartite NLS with the sequence KRPAATKKAGQAKKKK (SEQ ID NO: 3)); the c-myc NLS having the amino acid sequence PAAKRVKLD (SEQ ID NO: 4) or RQRRNELKRSP (SEQ ID NO: 5); the hRNPA1 M9 NLS having the sequence NQSSNFGPMKGGNFGGRSSGPYGGGGQYFAK-PRNQGGY (SEQ ID NO: 6); the sequence RMRIZFKNKGKDTAELRRRRVEVSVELRKAKKD-EQILKRRNV (SEQ ID NO: 7) of the IBB domain from importin-alpha; the sequences VSRKRPRP (SEQ ID NO: 8) and PPKKARED (SEQ ID NO: 9) of the myoma T protein; the sequence PQPKKKPL (SEQ ID NO: 10) of human p53; the sequence SALIKKKKKMAP (SEQ ID NO: 11) of mouse c-abl IV; the sequences DRLRR (SEQ ID NO: 12) and PKQKKRK (SEQ ID NO: 13) of the influenza virus NS1; the sequence RKLKKKIKKL (SEQ ID NO: 14) of the Hepatitis virus delta antigen; the sequence REKKKFLKRR (SEQ ID NO: 15) of the mouse Mx1 protein; the sequence KRKGDEVDGVDEVAKKKSKK (SEQ ID NO: 16) of the human poly(ADP-ribose) polymerase; and the sequence RKCLQAGMNLEARKTKK (SEQ ID NO: 17) of the steroid hormone receptors (human) glucocorticoid. In general, the one or more NLSs are of sufficient strength to drive accumulation of the DNA-targeting Cas protein in a detectable amount in the nucleus of a eukaryotic cell. In general, strength of nuclear localization activity may derive from the number of NLSs in the nucleic acid-targeting effector protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of nucleic acid-targeting complex formation (e.g., assay for DNA cleavage or mutation at the target sequence, or assay for altered gene expression activity affected by DNA-targeting complex formation and/or DNA-targeting Cas protein activity), as compared to a control not exposed to the nucleic acid-targeting Cas protein or nucleic acid-targeting complex, or exposed to a nucleic acid-targeting Cas protein lacking the one or more NLSs. In preferred embodiments of the herein described Cpf1 effector protein complexes and systems the codon optimized Cpf1 effector proteins comprise an NLS attached to the C-terminal of the protein.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector proteins or has cells containing nucleic acid-targeting effector proteins, such as by way of prior administration thereto of a vector or vectors that code for and express in vivo nucleic acid-targeting effector proteins. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a nucleic acid-targeting effector protein. Nucleic acid-targeting effector protein or nucleic acid-targeting guide RNA or RNA(s) can be delivered separately; and advantageously at least one of these is delivered via a particle complex. nucleic acid-targeting effector protein mRNA can be delivered prior to the nucleic acid-targeting guide RNA to give time for nucleic acid-targeting effector protein to be expressed. Nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+ guide RNA. Additional administrations of nucleic acid-targeting effector protein mRNA and/or guide RNA might be useful to achieve the most efficient levels of genome modification.

In one aspect, the invention provides methods for using one or more elements of a nucleic acid-targeting system. The nucleic acid-targeting complex of the invention provides an effective means for modifying a target DNA (single or double stranded, linear or super-coiled). The nucleic acid-targeting complex of the invention has a wide variety of utility including modifying (e.g., deleting, inserting, translocating, inactivating, activating) a target DNA in a multiplicity of cell types. As such the nucleic acid-targeting complex of the invention has a broad spectrum of applications in, e.g., gene therapy, drug screening, disease diagnosis, and prognosis. An exemplary nucleic acid-targeting complex comprises a DNA-targeting effector protein complexed with a guide RNA hybridized to a target sequence within the target locus of interest.

In one aspect, the invention provides for methods of modifying a target polynucleotide. In some embodiments, the method comprises allowing a CRISPR complex to bind to the target polynucleotide to effect cleavage of said target polynucleotide thereby modifying the target polynucleotide, wherein the CRISPR complex comprises a CRISPR enzyme (including any of the modified enzymes, such as deadCpf1 or Cpf1 nickase, etc.) as described herein) complexed with a guide sequence (including any of the modified guides of guide sequences as described herein) hybridized to a target sequence within said target polynucleotide, preferably wherein said guide sequence is linked to a direct repeat sequence. In one aspect, the invention provides a method of modifying expression of DNA in a eukaryotic cell, such that said binding results in increased or decreased expression of said DNA. In some embodiments, the method comprises allowing a nucleic acid-targeting complex to bind to the DNA such that said binding results in increased or decreased expression of said DNA; wherein the nucleic acid-targeting complex comprises a nucleic acid-targeting effector protein complexed with a guide RNA. In some embodiments, the method further comprises delivering one or more vectors to said eukaryotic cells, wherein the one or more vectors drive expression of one or more of: the Cpf1, and the (multiple) guide sequence linked to the DR sequence. Similar considerations and conditions apply as above for methods of modifying a target DNA. In fact, these sampling, culturing and re-introduction options apply across the aspects of the present invention. In one aspect, the invention provides for methods of modifying a target DNA in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells. The cells can be modified according to the invention to produce gene products, for example in controlled amounts, which may be increased or decreased, depending on use, and/or mutated. In certain embodiments, a genetic locus of the cell is repaired.

Indeed, in any aspect of the invention, the nucleic acid-targeting complex may comprise a nucleic acid-targeting effector protein complexed with a guide RNA hybridized to a target sequence.

The invention relates to the engineering and optimization of systems, methods and compositions used for the control of gene expression involving DNA sequence targeting, that relate to the nucleic acid-targeting system and components thereof. In advantageous embodiments, the effector enzyme is a Type V protein such as Cpf1. An advantage of the present methods is that the CRISPR system minimizes or avoids off-target binding and its resulting side effects. This is achieved using systems arranged to have a high degree of sequence specificity for the target DNA.

In relation to a nucleic acid-targeting complex or system preferably, the crRNA sequence has one or more stem loops or hairpins and is 30 or more nucleotides in length, 40 or more nucleotides in length, or 50 or more nucleotides in length; the crRNA sequence is between 10 to 30 nucleotides in length, the nucleic acid-targeting effector protein is a Type V Cas enzyme. In certain embodiments, the crRNA sequence is between 42 and 44 nucleotides in length, and the nucleic acid-targeting Cas protein is Cpf1 of *Francisella tularensis* subsp. *novocida* U112. In certain embodiments, the crRNA comprises, consists essentially of, or consists of 19 nucleotides of a direct repeat and between 23 and 25 nucleotides of spacer sequence, and the nucleic acid-targeting Cas protein is Cpf1 of *Francisella tularensis* subsp. *novocida* U112. The use of two different aptamers (each associated with a distinct nucleic acid-targeting guide RNAs) allows an activator-adaptor protein fusion and a repressor-adaptor protein fusion to be used, with different nucleic acid-targeting guide RNAs, to activate expression of one DNA, whilst repressing another. They, along with their different guide RNAs can be administered together, or substantially together, in a multiplexed approach. A large number of such modified nucleic acid-targeting guide RNAs can be used all at the same time, for example 10 or 20 or 30 and so forth, whilst only one (or at least a minimal number) of effector protein molecules need to be delivered, as a comparatively small number of effector protein molecules can be used with a large number modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the nucleic acid-targeting effector protein-guide RNA complex as a whole may be associated with two or more functional domains. For example, there may be two or more functional domains associated with the nucleic acid-targeting effector protein, or there may be two or more functional domains associated with the guide RNA (via one or more adaptor proteins), or there may be one or more functional domains associated with the nucleic acid-targeting effector protein and one or more functional domains associated with the guide RNA (via one or more adaptor proteins).

The fusion between the adaptor protein and the activator or repressor may include a linker. For example, GlySer linkers GGGS (SEQ ID NO: 18) can be used. They can be used in repeats of 3 ((GGGGS)$_3$ (SEQ ID NO: 19)) or 6 (SEQ ID NO: 20), 9 (SEQ ID NO: 21) or even 12 (SEQ ID NO: 22) or more, to provide suitable lengths, as required. Linkers can be used between the guide RNAs and the functional domain (activator or repressor), or between the nucleic acid-targeting Cas protein (Cas) and the functional domain (activator or repressor). The linkers the user to engineer appropriate amounts of "mechanical flexibility".

The invention comprehends a nucleic acid-targeting complex comprising a nucleic acid-targeting effector protein and a guide RNA, wherein the nucleic acid-targeting effector protein comprises at least one mutation, such that the nucleic acid-targeting effector protein has no more than 5% of the activity of the nucleic acid-targeting effector protein not having the at least one mutation and, optional, at least one or more nuclear localization sequences; the guide RNA comprises a guide sequence capable of hybridizing to a target sequence in a RNA of interest in a cell; and wherein: the nucleic acid-targeting effector protein is associated with two or more functional domains; or at least one loop of the guide RNA is modified by the insertion of distinct RNA sequence(s) that bind to one or more adaptor proteins, and wherein the adaptor protein is associated with two or more functional domains; or the nucleic acid-targeting Cas protein is associated with one or more functional domains and at least one loop of the guide RNA is modified by the insertion of distinct RNA sequence(s) that bind to one or more adaptor proteins, and wherein the adaptor protein is associated with one or more functional domains.

In one aspect, the invention provides a method of generating a model eukaryotic cell comprising a mutated disease gene. In some embodiments, a disease gene is any gene associated an increase in the risk of having or developing a disease. In some embodiments, the method comprises (a) introducing one or more vectors into a eukaryotic cell, wherein the one or more vectors drive expression of one or more of: a Cpf1 enzyme and a protected guide RNA comprising a guide sequence linked to a direct repeat sequence; and (b) allowing a CRISPR complex to bind to a target polynucleotide to effect cleavage of the target polynucleotide within said disease gene, wherein the CRISPR complex comprises the Cpf1 enzyme complexed with the guide RNA comprising the sequence that is hybridized to the target sequence within the target polynucleotide, thereby generating a model eukaryotic cell comprising a mutated disease gene. In some embodiments, said cleavage comprises cleaving one or two strands at the location of the target sequence by said Cpf1 enzyme. In some embodiments, said cleavage results in decreased transcription of a target gene. In some embodiments, the method further comprises repairing said cleaved target polynucleotide by non-homologous end joining (NHEJ)-based gene insertion mechanisms with an exogenous template polynucleotide, wherein said repair results in a mutation comprising an insertion, deletion, or substitution of one or more nucleotides of said target polynucleotide. In some embodiments, said mutation results in one or more amino acid changes in a protein expression from a gene comprising the target sequence.

In an aspect the invention provides methods as herein discussed wherein the host is a eukaryotic cell. In an aspect the invention provides a method as herein discussed wherein the host is a mammalian cell. In an aspect the invention provides a method as herein discussed, wherein the host is a non-human eukaryote cell. In an aspect the invention provides a method as herein discussed, wherein the non-human eukaryote cell is a non-human mammal cell. In an aspect the invention provides a method as herein discussed, wherein the non-human mammal cell may be including, but not limited to, primate bovine, ovine, procine, canine, rodent, Leporidae such as monkey, cow, sheep, pig, dog, rabbit, rat or mouse cell. In an aspect the invention provides a method as herein discussed, the cell may be a non-mammalian eukaryotic cell such as poultry bird (e.g., chicken), vertebrate fish (e.g., salmon) or shellfish (e.g., oyster, claim, lobster, shrimp) cell. In an aspect the invention provides a method as herein discussed, the non-human eukaryote cell is a plant cell. The plant cell may be of a monocot or dicot or of a crop or grain plant such as cassava, corn, sorghum, soybean, wheat, oat or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus *Lactuca*; plants of the genus *Spinacia*; plants of the genus *Capsicum*; cotton, tobacco, asparagus, carrot, cabbage, broccoli, cauliflower, tomato, eggplant, pepper, lettuce, spinach, strawberry, blueberry, raspberry, blackberry, grape, coffee, cocoa, etc).

In one aspect, the invention provides a method for developing a biologically active agent that modulates a cell signaling event associated with a disease gene. In some embodiments, a disease gene is any gene associated an increase in the risk of having or developing a disease. In some embodiments, the method comprises (a) contacting a test compound with a model cell of any one of the above-described embodiments; and (b) detecting a change in a readout that is indicative of a reduction or an augmentation of a cell signaling event associated with said mutation in said disease gene, thereby developing said biologically active agent that modulates said cell signaling event associated with said disease gene.

In one aspect the invention provides for a method of selecting one or more cell(s) by introducing one or more mutations in a gene in the one or more cell (s), the method comprising: introducing one or more vectors into the cell (s), wherein the one or more vectors drive expression of one or more of: Cpf1, a guide sequence linked to a direct repeat sequence, and an editing template; wherein the editing template comprises the one or more mutations that abolish Cpf1 cleavage; allowing homologous recombination of the editing template with the target polynucleotide in the cell(s) to be selected; allowing a Cpf1 CRISPR-Cas complex to bind to a target polynucleotide to effect cleavage of the target polynucleotide within said gene, wherein the Cpf1 CRISPR-Cas complex comprises the Cpf1 complexed with (1) the guide sequence that is hybridized to the target sequence within the target polynucleotide, and (2) the direct repeat sequence, wherein binding of the Cpf1 CRISPR-Cas complex to the target polynucleotide induces cell death, thereby allowing one or more cell(s) in which one or more mutations have been introduced to be selected; this includes the present split Cpf1. In another preferred embodiment of the invention the cell to be selected may be a eukaryotic cell. Aspects of the invention allow for selection of specific cells without requiring a selection marker or a two-step process that may include a counter-selection system.

In one aspect, the invention provides a recombinant polynucleotide comprising a guide sequence downstream of a direct repeat sequence, wherein the guide sequence when expressed directs sequence-specific binding of a Cpf1 CRISPR-Cas complex to a corresponding target sequence present in a eukaryotic cell. In some embodiments, the target sequence is a viral sequence present in a eukaryotic cell. In some embodiments, the target sequence is a proto-oncogene or an oncogene.

In one aspect, the invention provides a vector system or eukaryotic host cell comprising (a) a first regulatory element operably linked to a direct repeat sequence and one or more insertion sites for inserting one or more guide sequences (including any of the modified guide sequences as described herein) downstream of the DR sequence, wherein when expressed, the guide sequence directs sequence-specific binding of a Cpf1 CRISPR-Cas complex to a target sequence in a eukaryotic cell, wherein the Cpf1 CRISPR-Cas complex comprises Cpf1 (including any of the modified enzymes as described herein) complexed with the guide sequence that is hybridized to the target sequence (and optionally the DR sequence); and/or (b) a second regulatory element operably linked to an enzyme-coding sequence encoding said Cpf1 enzyme comprising a nuclear localization sequence and/or NES. In some embodiments, the host cell comprises components (a) and (b). In some embodiments, component (a), component (b), or components (a) and (b) are stably integrated into a genome of the host eukaryotic cell. In some embodiments, component (a) further comprises two or more guide sequences operably linked to the first regulatory element, wherein when expressed, each of the two or more guide sequences direct sequence specific binding of a Cpf1 CRISPR-Cas complex to a different target sequence in a eukaryotic cell. In some embodiments, the CRISPR enzyme comprises one or more nuclear localization sequences and/or nuclear export sequences or NES of sufficient strength to drive accumulation of said CRISPR enzyme in a detectable amount in and/or out of the nucleus of a eukaryotic cell. In some embodiments, the Cpf1 enzyme is derived from *Francisella tularensis* 1, *Francisella tularensis* subsp. *novicida*, *Prevotella albensis*, *Lachnospiraceae bacterium* MC2017 1, *Butyrivibrio proteoclasticus*, *Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens*, or *Porphyromonas macacae* Cpf1, including any of the modified enzymes as described herein, and may include further alteration or mutation of the Cpf1, and can be a chimeric Cpf1. In some embodiments, the CRISPR enzyme is codon-optimized for expression in a eukaryotic cell. In some embodiments, the CRISPR enzyme directs cleavage of one or two strands at the location of the target sequence. In a preferred embodiment, the strand break is a staggered cut with a 5' overhang. In some embodiments, the Cpf1 lacks DNA strand cleavage activity (e.g., no more than 5% nuclease activity as compared with a wild type enzyme or enzyme not having the mutation or alteration that decreases nuclease activity). In some embodiments, the first regulatory element is a polymerase III promoter. In some embodiments, the second regulatory element is a polymerase II promoter. In some embodiments, the direct repeat has a minimum length of 16 nts and a single stem loop. In further embodiments the direct repeat has a length longer than 16 nts, preferably more than 17 nts, and has more than one stem loop or optimized secondary structures. In some embodiments, the guide sequence is at least 16, 17, 18, 19, 20, 25 nucleotides, or between 16-30, or between 16-25, or between 16-20 nucleotides in length.

In one aspect, the invention provides a kit comprising one or more of the components described herein. In some embodiments, the kit comprises a vector system or host cell as described herein and instructions for using the kit.

Modified Cpf1 Enzymes

Computational analysis of the primary structure of Cpf1 nucleases reveals three distinct regions (FIG. 72). First a C-terminal RuvC like domain, which is the only functional characterized domain. Second a N-terminal alpha-helical region and thirst a mixed alpha and beta region, located between the RuvC like domain and the alpha-helical region.

Several small stretches of unstructured regions are predicted within the Cpf1 primary structure. Unstructured regions, which are exposed to the solvent and not conserved within different Cpf1 orthologs, are preferred sides for splits and insertions of small protein sequences. In addition, these sides can be used to generate chimeric proteins between Cpf1 orthologs.

Based on the above information, mutants can be generated which lead to inactivation of the enzyme or which modify the double strand nuclease to nickase activity. In alternative embodiments, this information is used to develop enzymes with reduced off-target effects (described elsewhere herein)

In certain of the above-described Cpf1 enzymes, the enzyme is modified by mutation of one or more residues including but not limited to positions D917, E1006, E1028, D1227, D1255A, N1257, according to FnCpf1 protein or any corresponding ortholog. In an aspect the invention provides a herein-discussed composition wherein the Cpf1 enzyme is an inactivated enzyme which comprises one or more mutations selected from the group consisting of D917A, E1006A, E1028A, D1227A, D1255A, N1257A, D917A, E1006A, E1028A, D1227A, D1255A and N1257A according to FnCpf1 protein or corresponding positions in a Cpf1 ortholog. In an aspect the invention provides a herein-discussed composition, wherein the CRISPR enzyme comprises D917, or E1006 and D917, or D917 and D1255, according to FnCpf1 protein or a corresponding position in a Cpf1 ortholog.

In certain of the above-described Cpf1 enzymes, the enzyme is modified by mutation of one or more residues (in the RuvC domain) including but not limited to positions R909, R912, R930, R947, K949, R951, R955, K965, K968, K1000, K1002, R1003, K1009, K1017, K1022, K1029, K1035, K1054, K1072, K1086, R1094, K1095, K1109, K1118, K1142, K1150, K1158, K1159, R1220, R1226, R1242, and/or R1252 with reference to amino acid position numbering of AsCpf1 (Acidaminococcus sp. BV3L6).

In certain of the above-described non-naturally-occurring CRISPR enzymes, the enzyme is modified by mutation of one or more residues (in the RAD50) domain including but not limited positions K324, K335, K337, R331, K369, K370, R386, R392, R393, K400, K404, K406, K408, K414, K429, K436, K438, K459, K460, K464, R670, R675, R681, K686, K689, R699, K705, R725, K729, K739, K748, and/or K752 with reference to amino acid position numbering of AsCpf1 (Acidaminococcus sp. BV3L6).

In certain of the Cpf1 enzymes, the enzyme is modified by mutation of one or more residues including but not limited positions R912, T923, R947, K949, R951, R955, K965, K968, K1000, R1003, K1009, K1017, K1022, K1029, K1072, K1086, F1103, R1226, and/or R1252 with reference to amino acid position numbering of AsCpf1 (Acidaminococcus sp. BV3L6).

In certain embodiments, the Cpf1 enzyme is modified by mutation of one or more residues including but not limited positions R833, R836, K847, K879, K881, R883, R887, K897, K900, K932, R935, K940, K948, K953, K960, K984, K1003, K1017, R1033, R1138, R1165, and/or R1252 with reference to amino acid position numbering of LbCpf1 (Lachnospiraceae bacterium ND2006).

In certain embodiments, the Cpf1 enzyme is modified by mutation of one or more residues including but not limited positions K15, R18, K26, Q34, R43, K48, K51, R56, R84, K85, K87, N93, R103, N104, T118, K123, K134, R176, K177, R192, K200, K226, K273, K275, T291, R301, K307, K369, S404, V409, K414, K436, K438, K468, D482, K516, R518, K524, K530, K532, K548, K559, K570, R574, K592, D596, K603, K607, K613, C647, R681, K686, H720, K739, K748, K757, T766, K780, R790, P791, K796, K809, K815, T816, K860, R862, R863, K868, K897, R909, R912, T923, R947, K949, R951, R955, K965, K968, K1000, R1003, K1009, K1017, K1022, K1029, A1053, K1072, K1086, F1103, S1209, R1226, R1252, K1273, K1282, and/or K1288 with reference to amino acid position numbering of AsCpf1 (Acidaminococcus sp. BV3L6).

In certain embodiments, the enzyme is modified by mutation of one or more residues including but not limited positions K15, R18, K26, R34, R43, K48, K51, K56, K87, K88, D90, K96, K106, K107, K120, Q125, K143, R186, K187, R202, K210, K235, K296, K298, K314, K320, K326, K397, K444, K449, E454, A483, E491, K527, K541, K581, R583, K589, K595, K597, K613, K624, K635, K639, K656, K660, K667, K671, K677, K719, K725, K730, K763, K782, K791, R800, K809, K823, R833, K834, K839, K852, K858, K859, K869, K871, R872, K877, K905, R918, R921, K932, I960, K962, R964, R968, K978, K981, K1013, R1016, K1021, K1029, K1034, K1041, K1065, K1084, and/or K1098 with reference to amino acid position numbering of FnCpf1 (Francisella novicida U112).

In certain embodiments, the enzyme is modified by mutation of one or more residues including but not limited positions K15, R18, K26, K34, R43, K48, K51, R56, K83, K84, R86, K92, R102, K103, K116, K121, R158, E159, R174, R182, K206, K251, K253, K269, K271, K278, P342, K380, R385, K390, K415, K421, K457, K471, A506, R508, K514, K520, K522, K538, Y548, K560, K564, K580, K584, K591, K595, K601, K634, K640, R645, K679, K689, K707, T716, K725, R737, R747, R748, K753, K768, K774, K775, K785, K787, R788, Q793, K821, R833, R836, K847, K879, K881, R883, R887, K897, K900, K932, R935, K940, K948, K953, K960, K984, K1003, K1017, R1033, K1121, R1138, R1165, K1190, K1199, and/or K1208 with reference to amino acid position numbering of LbCpf1 (Lachnospiraceae bacterium ND2006).

In certain embodiments, the enzyme is modified by mutation of one or more residues including but not limited positions K14, R17, R25, K33, M42, Q47, K50, D55, K85, N86, K88, K94, R104, K105, K118, K123, K131, R174, K175, R190, R198, I221, K267, Q269, K285, K291, K297, K357, K403, K409, K414, K448, K460, K501, K515, K550, R552, K558, K564, K566, K582, K593, K604, K608, K623, K627, K633, K637, E643, K780, Y787, K792, K830, Q846, K858, K867, K876, K890, R900, K901, M906, K921, K927, K928, K937, K939, R940, K945, Q975, R987, R990, K1001, R1034, I1036, R1038, R1042, K1052, K1055, K1087, R1090, K1095, N1103, K1108, K1115, K1139, K1158, R1172, K1188, K1276, R1293, A1319, K1340, K1349, and/or K1356 with reference to amino acid position numbering of MbCpf1 (*Moraxella bovoculi* 237).

Deactivated/Inactivated Cpf1 Protein

Where the Cpf1 protein has nuclease activity, the Cpf1 protein may be modified to have diminished nuclease activity e.g., nuclease inactivation of at least 70%, at least 80%, at least 90%, at least 95%, at least 97%, or 100% as compared with the wild type enzyme; or to put in another way, a Cpf1 enzyme having advantageously about 0% of the nuclease activity of the non-mutated or wild type Cpf1 enzyme or CRISPR enzyme, or no more than about 3% or about 5% or about 10% of the nuclease activity of the non-mutated or wild type Cpf1 enzyme, e.g. of the non-mutated or wild type *Francisella novicida* U112 (FnCpf1), *Acidaminococcus* sp. BV3L6 (AsCpf1), *Lachnospiraceae bacterium* ND2006 (LbCpf1) or *Moraxella bovoculi* 237 (MbCpf1 Cpf1 enzyme or CRISPR enzyme. This is possible by introducing mutations into the nuclease domains of the Cpf1 and orthologs thereof.

More particularly, the inactivated Cpf1 enzymes include enzymes mutated in amino acid positions As908, As993, As1263 of AsCpf1 or corresponding positions in Cpf1 orthologs. Additionally, the inactivated Cpf1 enzymes include enzymes mutated in amino acid position Lb832, 925, 947 or 1180 of LbCpf1 or corresponding positions in Cpf1 orthologs. More particularly, the inactivated Cpf1 enzymes include enzymes comprising one or more of mutations AsD908A, AsE993A, AsD1263A of AsCpf1 or corresponding mutations in Cpf1 orthologs. Additionally, the inactivated Cpf1 enzymes include enzymes comprising one or more of mutations LbD832A, E925A, D947A or D1180A of LbCpf1 or corresponding mutations in Cpf1 orthologs.

The inactivated Cpf1 CRISPR enzyme may have associated (e.g., via fusion protein) one or more functional domains, including for example, one or more domains from the group comprising, consisting essentially of, or consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). Preferred domains are Fok1, VP64, P65, HSF1, MyoD1. In the event that Fok1 is provided, it is advantageous that multiple Fok1 functional domains are provided to allow for a functional dimer and that gRNAs are designed to provide proper spacing for functional use (Fok1) as specifically described in Tsai et al. Nature Biotechnology, Vol. 32, Number 6, June 2014). The adaptor protein may utilize known linkers to attach such functional domains. In some cases it is advantageous that additionally at least one NLS is provided. In some instances, it is advantageous to position the NLS at the N terminus. When more than one functional domain is included, the functional domains may be the same or different.

In general, the positioning of the one or more functional domain on the inactivated Cpf1 enzyme is one which allows for correct spatial orientation for the functional domain to affect the target with the attributed functional effect. For example, if the functional domain is a transcription activator (e.g., VP64 or p65), the transcription activator is placed in a spatial orientation which allows it to affect the transcription of the target. Likewise, a transcription repressor will be advantageously positioned to affect the transcription of the target, and a nuclease (e.g., Fok1) will be advantageously positioned to cleave or partially cleave the target. This may include positions other than the N-/C-terminus of the CRISPR enzyme.

Enzymes According to the Invention can be Applied in Optimized Functional CRISPR-Cas Systems which are of Interest for Functional Screening In an aspect the invention provides non-naturally occurring or engineered composition comprising a Type V, more particularly Cpf1 CRISPR guide RNAs comprising a guide sequence capable of hybridizing to a target sequence in a genomic locus of interest in a cell, wherein the guide RNA is modified by the insertion of distinct RNA sequence(s) that bind to two or more adaptor proteins (e.g. aptamers), and wherein each adaptor protein is associated with one or more functional domains; or, wherein the guide RNA is modified to have at least one non-coding functional loop. In particular embodiments, the guide RNA is modified by the insertion of distinct RNA sequence(s) 5' of the direct repeat, within the direct repeat, or 3' of the guide sequence. When there is more than one functional domain, the functional domains can be same or different, e.g., two of the same or two different activators or repressors. In an aspect the invention provides non-naturally occurring or engineered CRISPR-Cas complex composition comprising the guide RNA as herein-discussed and a CRISPR enzyme which is a Cpf1 enzyme, wherein optionally the Cpf1 enzyme comprises at least one mutation, such that the Cpf1 enzyme has no more than 5% of the nuclease activity of the Cpf1 enzyme not having the at least one mutation, and optionally one or more comprising at least one or more nuclear localization sequences. In an aspect the invention provides a herein-discussed Cpf1 CRISPR guide RNA or the Cpf1 CRISPR-Cas complex including a non-naturally occurring or engineered composition comprising two or more adaptor proteins, wherein each protein is associated with one or more functional domains and wherein the adaptor protein binds to the distinct RNA sequence(s) inserted into the guide RNA. In particular embodiments, the guide RNA is additionally or alternatively modified so as to still ensure binding of the Cpf1 CRISPR complex but to prevent cleavage by the Cpf1 enzyme (as detailed elsewhere herein).

In an aspect the invention provides a non-naturally occurring or engineered composition comprising a guide RNA (gRNA) comprising a guide sequence capable of hybridizing to a target sequence in a genomic locus of interest in a cell, a Cpf1 enzyme comprising at least one or more nuclear localization sequences, wherein the Cpf1 enzyme comprises at least one mutation, such that the Cpf1 enzyme has no more than 5% of the nuclease activity of the Cpf1 enzyme not having the at least one mutation, wherein the guide RNA is modified by the insertion of distinct RNA sequence(s) that bind to one or more adaptor proteins, and wherein the adaptor protein is associated with one or more functional domains; or, wherein the guide RNA is modified to have at least one non-coding functional loop, and wherein the composition comprises two or more adaptor proteins, wherein the each protein is associated with one or more functional domains. In an aspect the invention provides a herein-discussed composition, wherein the Cpf1 enzyme has a diminished nuclease activity of at least 97%, or 100% as compared with the Cpf1 enzyme not having the at least one mutation. In an aspect the invention provides a herein-discussed composition, wherein the Cpf1 enzyme comprises two or more mutations. The mutations may be selected from D917A, E1006, E1028, D1227, D1255A, N1257, according to FnCpf1 protein or a corresponding position in an ortholog. The amino acid mutations in may be selected from D908A, E993A, D1263A according to AsCpf1 protein or a corresponding position in an ortholog. The amino acid mutations may be selected from D832A, E925A, D947A or D1180A according to LbCpf1 protein or a corresponding position in an ortholog. In an aspect the invention provides a herein-discussed composition wherein the Cpf1 enzyme comprises two or more mutations selected from the group consisting of D917A, E1006A, E1028A, D1227A, D1255A, N1257A, D917A, E1006A, E1028A, D1227A, D1255A and N1257A according to FnCpf1 protein or any corresponding ortholog or D908A, E993A, D1263A according to AsCpf1 protein or a corresponding position in an ortholog or D832A, E925A, D947A or D1180A according to LbCpf1 protein or a corresponding position in an ortholog. In an aspect the invention provides a herein-discussed composition, wherein the CRISPR enzyme comprises D917, or E1006 and D917, or D917 and D1255, according to FnCpf1 protein or any corresponding ortholog or D908, E993, D1263 according to AsCpf1 protein or a corresponding position in an ortholog or D832, E925, D947 or D1180A according to LbCpf1 protein or a corresponding position in an ortholog. In an aspect the invention provides a herein-discussed composition, wherein the Cpf1 enzyme is associated with one or more functional domains. In an aspect the invention provides a herein-discussed composition, wherein the two or more functional domains associated with the adaptor protein are each a heterologous functional domain. In an aspect the invention provides a herein-discussed composition, wherein the one or more functional domains associated with the Cpf1 enzyme are each a heterologous functional domain. In an aspect the invention provides a herein-discussed composition, wherein the adaptor protein is a fusion protein comprising the functional domain, the fusion protein optionally comprising a linker between the adaptor protein and the functional domain, the linker optionally including a GlySer linker. In an aspect the invention provides a herein-discussed composition, wherein the gRNA is not modified by the insertion of distinct RNA sequence(s) that bind to the two or more adaptor proteins. In an aspect the invention provides a herein-discussed composition, wherein the one or more functional domains associated with the adaptor protein is a transcriptional activation domain. In an aspect the invention provides a herein-discussed composition, wherein the one or more functional domains associated with the Cpf1 enzyme is a transcriptional activation domain. In an aspect the invention provides a herein-discussed composition, wherein the one or more functional domains associated with the adaptor protein is a transcriptional activation domain comprising VP64, p65, MyoD1, HSF1, RTA or SET7/9. In particular embodiments, the functional domain is the catalytic histone acetyltransferase (HAT) core domain of the human E1A-associated protein p300 (aa 1048-1664). The p300 histone acetyltransferase protein catalyzes acetylation of histone H3 lysine 27 at its target sites and releases the DNA from its heterochromatin state so as to facilitate transcription thereof (Hilton et al. 2015, Nature Nature Biotechnology, 33: 510-517). In an aspect the invention provides a herein-discussed composition, wherein the one or more functional domains associated with the Cpf1 enzyme is a transcriptional activation domain comprises VP64, p65, MyoD1, HSF1, RTA, SET7/9 or the core p300 domain. In an aspect the invention provides a herein-discussed composition, wherein the one or more functional domains associated with the adaptor protein is a transcriptional repressor domain. In an aspect the invention provides a herein-discussed composition, wherein the one or more functional domains associated with the Cpf1 enzyme is a transcriptional repressor domain. In an aspect the invention provides a herein-discussed composition, wherein the transcriptional repressor domain is a KRAB domain. In an aspect the invention provides a herein-discussed composition, wherein the transcriptional repressor domain is a NuE domain, NcoR domain, SID domain or a SID4X domain. In an aspect the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity. In an aspect the invention provides a herein-discussed composition, wherein the one or more functional domains associated with the Cpf1 enzyme have one or more activities comprising methylase activity, demethylase activity, transcription activation activity, transcription repression activity, transcription release factor activity, histone modification activity, DNA integration activity RNA cleavage activity, DNA cleavage activity, nucleic acid binding activity, or molecular switch activity or chemical inducibility or light inducibility. In an aspect the invention provides a herein-discussed composition, wherein the DNA cleavage activity is due to a Fok1 nuclease. In an aspect the invention provides a herein-discussed composition, wherein the one or more functional domains is attached to the Cpf1 enzyme so that upon binding to the gRNA and target the functional domain is in a spatial orientation allowing for the functional domain to function in its attributed function; or, optionally, wherein the one or more functional domains is attached to the Cpf1 enzyme via a linker, optionally a GlySer linker. In an aspect the invention provides a herein-discussed composition, wherein the gRNA is modified so that, after gRNA binds the adaptor protein and further binds to the Cpf1 enzyme and target, the functional domain is in a spatial orientation allowing for the functional domain to function in its attributed function. In an aspect the invention provides a herein-discussed composition, wherein the one or more functional domains associated with the Cpf1 enzyme is attached to the RuvC domain of Cpf1. In an aspect the invention provides a herein-discussed composition, wherein the direct repeat of the guide RNA is modified by the insertion of the distinct RNA sequence(s). In an aspect the invention provides a herein-discussed composition, wherein the insertion of distinct RNA sequence(s) that bind to one or more adaptor proteins is an aptamer sequence. In an aspect the invention provides a herein-discussed composition, wherein the aptamer sequence is two or more aptamer sequences specific to the same adaptor protein. In an aspect the invention provides a herein-discussed composition, wherein the aptamer sequence is two or more aptamer sequences specific to different adaptor protein. In an aspect the invention provides a herein-discussed composition, wherein the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. Accordingly, in particular embodiments, the aptamer is selected from an RNA sequence specifically binding any one of the adaptor proteins listed above. In an aspect the invention provides a herein-discussed composition, wherein the cell is a eukaryotic cell. In an aspect the invention provides a herein-discussed composition, wherein the eukaryotic cell is a mammalian cell, a plant cell or a yeast cell, whereby the mammalian cell is optionally a mouse cell. In an aspect the invention provides a herein-discussed composition, wherein the mammalian cell is a human cell. In an aspect the invention provides a herein-discussed composition, wherein a first adaptor protein is associated with a p65 domain and a second adaptor protein is associated with a HSF1 domain. In an aspect the invention provides a herein-discussed composition, wherein the composition comprises a CRISPR-Cas complex having at least three functional domains, at least one of which is associated with the Cpf1 enzyme and at least two of which are associated with gRNA.

In an aspect there is more than one gRNA, and the gRNAs target different sequences whereby when the composition is employed, there is multiplexing. In an aspect the invention provides a composition wherein there is more than one gRNA modified by the insertion of distinct RNA sequence(s) that bind to one or more adaptor proteins.

In an aspect one or more adaptor proteins associated with one or more functional domains is present and bound to the distinct RNA sequence(s) inserted into the guide RNA.

In an aspect the target sequence(s) are non-coding or regulatory sequences. The regulatory sequences can be promoter, enhancer or silencer sequence(s).

In an aspect the guide RNA is modified to have at least one non-coding functional loop; e.g., wherein the at least one non-coding functional loop is repressive; for instance, wherein at least one non-coding functional loop comprises Alu.

In an aspect the invention provides a method of screening for gain of function (GOF) or loss of function (LOF) or for screen non-coding RNAs or potential regulatory regions (e.g. enhancers, repressors) comprising the cell line of as herein-discussed or cells of the model herein-discussed containing or expressing Cpf1 and introducing a composition as herein-discussed into cells of the cell line or model, whereby the gRNA includes either an activator or a repressor, and monitoring for GOF or LOF respectively as to those cells as to which the introduced gRNA includes an activator or as to those cells as to which the introduced gRNA includes a repressor. The screening of the instant invention is referred to as a SAM screen.

In an aspect the invention provides a genome wide library comprising a plurality of Cpf1 guide RNAs (gRNAs) comprising guide sequences, each of which is capable of hybridizing to a target sequence in a genomic locus of interest in a cell and whereby the library is capable of targeting a plurality of target sequences in a plurality of genomic loci in a population of eukaryotic cells, wherein each gRNA is modified by the insertion of distinct RNA sequence(s) that binds to one or more or two or more adaptor proteins, and wherein the adaptor protein is associated with one or more functional domains; or, wherein the gRNA is modified to have at least one non-coding functional loop. And when there is more than one functional domain, the functional domains can be same or different, e.g., two of the same or two different activators or repressors. In an aspect the invention provides a library of non-naturally occurring or engineered CRISPR-Cas complexes composition(s) comprising gRNAs of this invention and a Cpf1 enzyme, wherein optionally the Cpf1 enzyme comprises at least one mutation, such that the Cpf1 enzyme has no more than 5% of the nuclease activity of the Cpf1 enzyme not having the at least one mutation, and optionally one or more comprising at least one or more nuclear localization sequences. In an aspect the invention provides a gRNA(s) or Cpf1 CRISPR-Cas complex(es) of the invention including a non-naturally occurring or engineered composition comprising one or two or more adaptor proteins, wherein each protein is associated with one or more functional domains and wherein the adaptor protein binds to the distinct RNA sequence(s) inserted into the at least one loop of the gRNA.

In an aspect the invention provides a library of non-naturally occurring or engineered compositions, each comprising a Cpf1 CRISPR guide RNA (gRNA) comprising a guide sequence capable of hybridizing to a target sequence in a genomic locus of interest in a cell, a Cpf1 enzyme comprising at least one or more nuclear localization sequences, wherein the Cpf1 enzyme comprises at least one mutation, such that the Cpf1 enzyme has no more than 5% of the nuclease activity of the Cpf1 enzyme not having the at least one mutation, wherein at least one loop of the gRNA is modified by the insertion of distinct RNA sequence(s) that bind to one or more adaptor proteins, and wherein the adaptor protein is associated with one or more functional domains, wherein the composition comprises one or more or two or more adaptor proteins, wherein the each protein is associated with one or more functional domains, and wherein the gRNAs comprise a genome wide library comprising a plurality of Cpf1 guide RNAs (gRNAs) as detailed above. In particular embodiments the cell population of cells is a population of eukaryotic cells. In an aspect the invention provides a library as herein discussed, wherein the eukaryotic cell is a mammalian cell, a plant cell or a yeast cell. In an aspect the invention provides a library as herein discussed, wherein the mammalian cell is a human cell. In an aspect the invention provides a library as herein discussed, wherein the population of cells is a population of embryonic stem (ES) cells. In an aspect the invention provides a library as herein discussed, wherein the target sequence in the genomic locus is a non-coding sequence. In an aspect the invention provides a library as herein discussed, wherein gene function of one or more gene products is altered by said targeting; or wherein as to gene function there is gain of function; or wherein as to gene function there is change of function; or wherein as to gene function there is reduced function; or wherein the screen is for non-coding RNAs or potential regulatory regions (e.g. enhancers, repressors). In an aspect the invention provides a library as herein discussed, wherein said targeting results in a knockout of gene function. In an aspect the invention provides a library as herein discussed, wherein the targeting is of about 100 or more sequences. In an aspect the invention provides a library as herein discussed, wherein the targeting is of about 1000 or more sequences. In an aspect the invention provides a library as herein discussed, wherein the targeting is of about 20,000 or more sequences. In an aspect the invention provides a library as herein discussed, wherein the targeting is of the entire genome. In an aspect the invention provides a library as herein discussed, wherein the targeting is of a panel of target sequences focused on a relevant or desirable pathway. In an aspect the invention provides a library as herein discussed, wherein the pathway is an immune pathway. In an aspect the invention provides a library as herein discussed, wherein the pathway is a cell division pathway. In an aspect the invention provides a library as herein discussed, wherein the alteration of gene function comprises: introducing into each cell in the population of cells a vector system of one or more vectors comprising an engineered, non-naturally occurring Cpf1 CRISPR-Cas system comprising I. a Cpf1 protein, and II. one or more type Cpf1 guide RNAs, wherein components I and II may be same or on different vectors of the system, integrating components I and II into each cell, wherein the guide sequence targets a unique gene in each cell, wherein the Cpf1 protein is operably linked to a regulatory element, wherein when transcribed, the guide RNA comprising the guide sequence directs sequence-specific binding of a Cpf1 CRISPR-Cas system to a target sequence in the genomic loci of the unique gene, inducing cleavage of the genomic loci by the Cpf1 protein, and confirming different mutations in a plurality of unique genes in each cell of the population of cells thereby generating a mutant cell library. In an aspect the invention provides a library as herein discussed, wherein the one or more vectors are plasmid vectors. In an aspect the invention provides a library as herein discussed, wherein the regulatory element is an inducible promoter. In an aspect the invention provides a library as herein discussed, wherein the inducible promoter is a doxycycline inducible promoter. In an aspect the invention provides a library as herein discussed wherein the confirming of different mutations is by whole exome sequencing. In an aspect the invention provides a library as herein discussed, wherein the mutation is achieved in 100 or more unique genes. In an aspect the invention provides a library as herein discussed, wherein the mutation is achieved in 1000 or more unique genes. In an aspect the invention provides a library as herein discussed, wherein the mutation is achieved in 20,000 or more unique genes. In an aspect the invention provides a library as herein discussed, wherein the mutation is achieved in the entire genome. In an aspect the invention provides a library as herein discussed, wherein the alteration of gene function is achieved in a plurality of unique genes which function in a particular physiological pathway or condition. In an aspect the invention provides a library as herein discussed, wherein the pathway or condition is an immune pathway or condition. In an aspect the invention provides a library as herein discussed, wherein the pathway or condition is a cell division pathway or condition. In an aspect the invention provides a library as herein discussed, wherein a first adaptor protein is associated with a p65 domain and a second adaptor protein is associated with a HSF1 domain. In an aspect the invention provides a library as herein discussed, wherein each Cpf1 CRISPR-Cas complex has at least three functional domains, at least one of which is associated with the Cpf1 enzyme and at least two of which are associated with gRNA. In an aspect the invention provides a library as herein discussed, wherein the alteration in gene function is a knockout mutation.

In an aspect the invention provides a method for functional screening genes of a genome in a pool of cells ex vivo or in vivo comprising the administration or expression of a library comprising a plurality of Cpf1 CRISPR-Cas system guide RNAs (gRNAs) and wherein the screening further comprises use of a Cpf1 enzyme, wherein the CRISPR complex is modified to comprise a heterologous functional domain. In an aspect the invention provides a method for screening a genome comprising the administration to a host or expression in a host in vivo of a library. In an aspect the invention provides a method as herein discussed further comprising an activator administered to the host or expressed in the host. In an aspect the invention provides a method as herein discussed wherein the activator is attached to a Cpf1 enzyme. In an aspect the invention provides a method as herein discussed wherein the activator is attached to the N terminus or the C terminus of the Cpf1 enzyme. In an aspect the invention provides a method as herein discussed wherein the activator is attached to the Cpf1 CRISPR gRNA direct repeat. In an aspect the invention provides a method as herein discussed further comprising a repressor administered to the host or expressed in the host. In an aspect the invention provides a method as herein discussed, wherein the screening comprises affecting and detecting gene activation, gene inhibition, or cleavage in the locus. In an aspect the invention provides a pair of Cpf1 CRISPR-Cas complexes, each comprising a Cpf1 guide RNA (gRNA) comprising a guide sequence capable of hybridizing to a target sequence in a genomic locus of interest in a cell, wherein said gRNA is modified by the insertion of distinct RNA sequence(s) that bind to one or more adaptor proteins, and wherein the adaptor protein is associated with one or more functional domains, wherein each gRNA of each Cpf1 CRISPR-Cas comprises a functional domain having a DNA cleavage activity. In an aspect the invention provides a paired Cpf1 CRISPR-Cas complexes as herein-discussed, wherein the DNA cleavage activity is due to a Fok1 nuclease.

In one aspect, the invention provides a method of generating a model eukaryotic cell comprising a gene with modified expression. In some embodiments, a disease gene is any gene associated an increase in the risk of having or developing a disease. In some embodiments, the method comprises (a) introducing one or more vectors described herein above into a eukaryotic cell, and (b) allowing a CRISPR complex to bind to a target polynucleotide so as to modify a genetic locus, thereby generating a model eukaryotic cell comprising a modified genetic locus.

In one aspect, the invention provides a method for developing a biologically active agent that modulates a cell signaling event associated with a disease gene. In some embodiments, a disease gene is any gene associated an increase in the risk of having or developing a disease. In some embodiments, the method comprises (a) contacting a test compound with a model cell of any one of the above-described embodiments; and (b) detecting a change in a readout that is indicative of a reduction or an augmentation of a cell signaling event associated with said mutation in said disease gene, thereby developing said biologically active agent that modulates said cell signaling event associated with said disease gene.

The invention comprehends optimized functional CRISPR-Cas Cpf1 enzyme systems, especially in combination with the present modified guides and also where the Cpf1 enzyme is also associated with a functional domain. In particular the Cpf1 enzyme comprises one or more mutations that converts it to a DNA binding protein to which functional domains exhibiting a function of interest may be recruited or appended or inserted or attached. In certain embodiments, the Cpf1 enzyme comprises one or more mutations which include but are not limited to D917A, E1006A, E1028A, D1227A, D1255A, N1257A, D917A, E1006A, E1028A, D1227A, D1255A and N1257 (based on the amino acid position numbering of a *Francisella tularensis* 1 *Novicida* Cpf1), D908A, E993A or AsD1263A (based on the amino acid position numbering of a *Acidaminococcus* sp. BV3L6 Cpf1) D832A, E925A, D947A or D1180A (based on the amino acid position numbering of a *Lachnospiraceae bacterium* Cpf1) and/or one or more mutations is in a RuvC1 domain of the Cpf1 enzyme or is a mutation as otherwise as discussed herein. In some embodiments, the Cpf1 enzyme has one or more mutations in a catalytic domain, wherein when transcribed, the guide sequence directs sequence-specific binding of a CRISPR complex to the target sequence, and wherein the enzyme further comprises a functional domain. In some embodiments, a mutation at E1006 according to FnCpf1 protein is preferred.

The structural information provided herein allows for interrogation of guide RNA interaction with the target DNA and the Cpf1 enzyme permitting engineering or alteration of guide RNA structure to optimize functionality of the entire Cpf1 CRISPR-Cas system. For example, loops of the guide RNA may be extended, without colliding with the Cpf1 protein by the insertion of adaptor proteins that can bind to RNA. These adaptor proteins can further recruit effector proteins or fusions which comprise one or more functional domains.

In general, the guide RNA are modified in a manner that provides specific binding sites (e.g. aptamers) for adapter proteins comprising one or more functional domains (e.g. via fusion protein) to bind to. The modified guide RNA are modified such that once the guide RNA forms a CRISPR complex (i.e. Cpf1 enzyme binding to guide RNA and target) the adapter proteins bind and, the functional domain on the adapter protein is positioned in a spatial orientation which is advantageous for the attributed function to be effective. For example, if the functional domain is a transcription activator (e.g. VP64 or p65), the transcription activator is placed in a spatial orientation which allows it to affect the transcription of the target. Likewise, a transcription repressor will be advantageously positioned to affect the transcription of the target and a nuclease (e.g. Fok1) will be advantageously positioned to cleave or partially cleave the target. The skilled person will understand that modifications to the guide RNA which allow for binding of the adapter+ functional domain but not proper positioning of the adapter+ functional domain (e.g. due to steric hindrance within the three dimensial structure of the CRISPR complex) are modifications which are not intended. The one or more modified guide RNA may be modified, by introduction of a distinct RNA sequence(s) 5' of the direct repeat, within the direct repeat, or 3' of the guide sequence.

As explained herein the functional domains may be, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). In some cases it is advantageous that additionally at least one NLS is provided. In some instances, it is advantageous to position the NLS at the N terminus. When more than one functional domain is included, the functional domains may be the same or different.

The guide RNA may be designed to include multiple binding recognition sites (e.g. aptamers) specific to the same or different adapter protein. The guide RNA of a Cpf1 enzyme is characterized in that it typically is 37-43 nucleotides and in that it contains only one stem loop. The guide RNA may be designed to bind to the promoter region −1000-+1 nucleic acids upstream of the transcription start site (i.e. TSS), preferably −200 nucleic acids. This positioning improves functional domains which affect gene activation (e.g. transcription activators) or gene inhibition (e.g. transcription repressors). The modified guide RNA may be one or more modified guide RNAs targeted to one or more target loci (e.g. at least 1 guide RNA, at least 2 guide RNA, at least 5 guide RNA, at least 10 guide RNA, at least 20 guide RNA, at least 30 guide RNA, at least 50 guide RNA) comprised in a composition.

Further, the Cpf1 enzyme with diminished nuclease activity is most effective when the nuclease activity is inactivated (e.g. nuclease inactivation of at least 70%, at least 80%, at least 90%, at least 95%, at least 97%, or 100% as compared with the wild type enzyme; or to put in another way, Cpf1 enzyme having advantageously about 0% of the nuclease activity of the non-mutated or wild type Cpf1 enzyme, or no more than about 3% or about 5% or about 10% of the nuclease activity of the non-mutated or wild type Cpf1 enzyme). This is possible by introducing mutations into the RuvC nuclease domains of the FnCpf1 or an ortholog thereof. For example utilizing mutations in a residue selected from the group consisting of D917A, E1006A, E1028A, D1227A, D1255A or N1257 as in FnCpf1 and more preferably introducing one or more of the mutations selected from the group consisting of locations D917A, E1006A, E1028A, D1227A, D1255A, N1257A, D917A, E1006A, E1028A, D1227A, D1255A and N1257 of FnCpf1 or a corresponding ortholog. In particular embodiments, the mutations are D917A with E1006A in FnCpf1. Alternatively it can be a residue selected from the group consisting of AsD908A, AsE993A, AsD1263A of AsCpf1 or a corresponding ortholog or LbD832A, E925A, D947A or D1180A of LbCpf1 or a corresponding ortholog.

The inactivated Cpf1 enzyme may have associated (e.g. via fusion protein) one or more functional domains, like for example as described herein for the modified guide RNA adaptor proteins, including for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). Preferred domains are Fok1, VP64, P65, HSF1, MyoD1. In the event that Fok1 is provided, it is advantageous that multiple Fok1 functional domains are provided to allow for a functional dimer and that guide RNAs are designed to provide proper spacing for functional use (Fok1) as specifically described in Tsai et al. Nature Biotechnology, Vol. 32, Number 6, June 2014). The adaptor protein may utilize known linkers to attach such functional domains. In some cases it is advantageous that additionally at least one NLS is provided. In some instances, it is advantageous to position the NLS at the N terminus. When more than one functional domain is included, the functional domains may be the same or different.

In general, the positioning of the one or more functional domain on the inactivated Cpf1 enzyme is one which allows for correct spatial orientation for the functional domain to affect the target with the attributed functional effect. For example, if the functional domain is a transcription activator (e.g. VP64 or p65), the transcription activator is placed in a spatial orientation which allows it to affect the transcription of the target. Likewise, a transcription repressor will be advantageously positioned to affect the transcription of the target, and a nuclease (e.g. Fok1) will be advantageously positioned to cleave or partially cleave the target. This may include positions other than the N-/C-terminus of the Cpf1 enzyme.

The adaptor protein may be any number of proteins that binds to an aptamer or recognition site introduced into the modified guide RNA and which allows proper positioning of one or more functional domains, once the guide RNA has been incorporated into the CRISPR complex, to affect the target with the attributed function. As explained in detail in this application such may be coat proteins, preferably bacteriophage coat proteins. The functional domains associated with such adaptor proteins (e.g. in the form of fusion protein) may include, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). Preferred domains are Fok1, VP64, P65, HSF1, MyoD1. In the event that the functional domain is a transcription activator or transcription repressor it is advantageous that additionally at least an NLS is provided and preferably at the N terminus. When more than one functional domain is included, the functional domains may be the same or different. The adaptor protein may utilize known linkers to attach such functional domains.

Enzyme Mutations Reducing Off-Target Effects

In one aspect, the invention provides a non-naturally occurring or engineered CRISPR enzyme, preferably a class 2 CRISPR enzyme, preferably a Type V CRISPR enzyme as described herein, such as preferably, but without limitation Cpf1 as described herein elsewhere, having one or more mutations resulting in reduced off-target effects, i.e. improved CRISPR enzymes for use in effecting modifications to target loci but which reduce or eliminate activity towards off-targets, such as when complexed to guide RNAs, as well as improved CRISPR enzymes for increasing the activity of CRISPR enzymes, such as when complexed with guide RNAs. It is to be understood that mutated enzymes as described herein below may be used in any of the methods according to the invention as described herein elsewhere. Any of the methods, products, compositions and uses as described herein elsewhere are equally applicable with the mutated CRISPR enzymes as further detailed below. It is to be understood, that in the aspects and embodiments as described herein, when referring to or reading on Cpf1 as the CRISPR enzyme, reconstitution of a functional CRISPR-Cas system preferably does not require or is not dependent on a tracr sequence and/or direct repeat is 5' (upstream) of the guide (target or spacer) sequence.

By means of further guidance, the following particular aspects and embodiments are provided.

The inventors have surprisingly determined that modifications may be made to CRISPR enzymes which confer reduced off-target activity compared to unmodified CRISPR enzymes and/or increased target activity compared to unmodified CRISPR enzymes. Thus, in certain aspects of the invention provided herein are improved CRISPR enzymes which may have utility in a wide range of gene modifying applications. Also provided herein are CRISPR complexes, compositions and systems, as well as methods and uses, all comprising the herein disclosed modified CRISPR enzymes.

In the context of this aspect of the invention, a Cpf1 or CRISPR enzyme is mutated or modified, "whereby the enzyme in the CRISPR complex has reduced capability of modifying one or more off-target loci as compared to an unmodified enzyme" (or like expressions); and, when reading this specification, the terms "Cpf1" or "Cas" or "CRISPR enzyme and the like are meant to include mutated or modified Cpf1 or Cas or CRISPR enzyme in accordance with the invention, i.e., "whereby the enzyme in the CRISPR complex has reduced capability of modifying one or more off-target loci as compared to an unmodified enzyme" (or like expressions).

In an aspect, the altered activity of the engineered CRISPR protein comprises an altered binding property as to the nucleic acid molecule comprising RNA or the target polynucleotide loci, altered binding kinetics as to the nucleic acid molecule comprising RNA or the target polynucleotide loci, or altered binding specificity as to the nucleic acid molecule comprising RNA or the target polynucleotide loci compared to off-target polynucleotide loci.

In some embodiments, a Cpf1 is considered to substantially lack all DNA cleavage activity when the DNA cleavage activity of the mutated enzyme is about no more than 25%, 10%, 5%, 1%, 0.1%, 0.01%, or less of the DNA cleavage activity of the non-mutated form of the enzyme; an example can be when the DNA cleavage activity of the mutated form is nil or negligible as compared with the non-mutated form. Thus, the Cpf1 may comprise one or more mutations and may be used as a generic DNA binding protein with or without fusion to a functional domain. The mutations may be artificially introduced mutations or gain- or loss-of-function mutations. The instant invention modification(s) or mutation(s) "whereby the enzyme in the CRISPR complex has reduced capability of modifying one or more off-target loci as compared to an unmodified enzyme and/or whereby the enzyme in the CRISPR complex has increased capability of modifying the one or more target loci as compared to an unmodified enzyme" (or like expressions) can be combined with mutations that result in the enzyme being a nickase or dead. Such a dead enzyme can be an enhanced nucleic acid molecule binder. And such a nickase can be an enhanced nickase. For instance, changing neutral amino acid(s) in and/or near the groove and/or other charged residues in other locations in Cas that are in close proximity to a nucleic acid (e.g., DNA, cDNA, RNA, gRNA to positive charged amino acid(s) may result in "whereby the enzyme in the CRISPR complex has reduced capability of modifying one or more off-target loci as compared to an unmodified enzyme and/or whereby the enzyme in the CRISPR complex has increased capability of modifying the one or more target loci as compared to an unmodified enzyme", e.g., more cutting. As this can be both enhanced on- and off-target cutting (a super cutting Cpf1), using such with what is known in the art as a tru-guide or tru-sgRNAs (see, e.g., Fu et al., "Improving CRISPR-Cas nuclease specificity using truncated guide RNAs," Nature Biotechnology 32, 279-284 (2014) doi:10.1038/nbt.2808 Received 17 Nov. 2013 Accepted 6 Jan. 2014 Published online 26 Jan. 2014 Corrected online 29 Jan. 2014) to have enhanced on target activity without higher off target cutting or for making super cutting nickases, or for combination with a mutation that renders the Cas dead for a super binder. In certain embodiments, the altered activity of the engineered Cpf1 protein comprises increased targeting efficiency or decreased off-target binding. In certain embodiments, the altered activity of the engineered Cpf1 protein comprises modified cleavage activity.

In certain embodiments, the altered activity comprises altered binding property as to the nucleic acid molecule comprising RNA or the target polynucleotide loci, altered binding kinetics as to the nucleic acid molecule comprising RNA or the target polynucleotide loci, or altered binding specificity as to the nucleic acid molecule comprising RNA or the target polynucleotide loci compared to off-target polynucleotide loci.

In certain embodiments, the altered activity comprises increased targeting efficiency or decreased off-target binding. In certain embodiments, the altered activity comprises modified cleavage activity. In certain embodiments, the altered activity comprises increased cleavage activity as to the target polynucleotide loci. In certain embodiments, the altered activity comprises decreased cleavage activity as to the target polynucleotide loci. In certain embodiments, the altered activity comprises decreased cleavage activity as to off-target polynucleotide loci. In certain embodiments, the altered activity comprises increased cleavage activity as to off-target polynucleotide loci.

In certain embodiments, the altered activity comprises increased cleavage activity as to the target polynucleotide loci. In certain embodiments, the altered activity comprises decreased cleavage activity as to the target polynucleotide loci. In certain embodiments, the altered activity comprises decreased cleavage activity as to off-target polynucleotide loci. In certain embodiments, the altered activity comprises increased cleavage activity as to off-target polynucleotide loci. Accordingly, in certain embodiments, there is increased specificity for target polynucleotide loci as compared to off-target polynucleotide loci. In other embodiments, there is reduced specificity for target polynucleotide loci as compared to off-target polynucleotide loci.

In an aspect of the invention, the altered activity of the engineered Cpf1 protein comprises altered helicase kinetics.

In an aspect of the invention, the engineered Cpf1 protein comprises a modification that alters association of the protein with the nucleic acid molecule comprising RNA, or a strand of the target polynucleotide loci, or a strand of off-target polynucleotide loci. In an aspect of the invention, the engineered Cpf1 protein comprises a modification that alters formation of the CRISPR complex.

In certain embodiments, the modified Cpf1 protein comprises a modification that alters targeting of the nucleic acid molecule to the polynucleotide loci. In certain embodiments, the modification comprises a mutation in a region of the protein that associates with the nucleic acid molecule. In certain embodiments, the modification comprises a mutation in a region of the protein that associates with a strand of the target polynucleotide loci. In certain embodiments, the modification comprises a mutation in a region of the protein that associates with a strand of the off-target polynucleotide loci. In certain embodiments, the modification or mutation comprises decreased positive charge in a region of the protein that associates with the nucleic acid molecule comprising RNA, or a strand of the target polynucleotide loci, or a strand of off-target polynucleotide loci. In certain embodiments, the modification or mutation comprises decreased negative charge in a region of the protein that associates with the nucleic acid molecule comprising RNA, or a strand of the target polynucleotide loci, or a strand of off-target polynucleotide loci. In certain embodiments, the modification or mutation comprises increased positive charge in a region of the protein that associates with the nucleic acid molecule comprising RNA, or a strand of the target polynucleotide loci, or a strand of off-target polynucleotide loci. In certain embodiments, the modification or mutation comprises increased negative charge in a region of the protein that associates with the nucleic acid molecule comprising RNA, or a strand of the target polynucleotide loci, or a strand of off-target polynucleotide loci. In certain embodiments, the modification or mutation increases steric hindrance between the protein and the nucleic acid molecule comprising RNA, or a strand of the target polynucleotide loci, or a strand of off-target polynucleotide loci. In certain embodiments, the modification or mutation comprises a substitution of Lys, His, Arg, Glu, Asp, Ser, Gly, or Thr. In certain embodiments, the modification or mutation comprises a substitution with Gly, Ala, Ile, Glu, or Asp. In certain embodiments, the modification or mutation comprises an amino acid substitution in a binding groove.

In some embodiments, the CRISPR enzyme, such as preferably Cpf1 enzyme is derived *Francisella tularensis* 1, *Francisella tularensis* subsp. *novicida*, *Prevotella albensis*, *Lachnospiraceae bacterium* MC2017 1, *Butyrivibrio proteoclasticus*, *Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens*, or *Porphyromonas macacae* Cpf1 (e.g., a Cpf1 of one of these organisms modified as described herein), and may include further mutations or alterations or be a chimeric Cpf1.

In certain embodiments, the enzyme is modified by or comprises modification, e.g., comprises, consists essentially of or consists of modification by mutation of any one of the residues listed herein or a corresponding residue in the respective orthologue; or the enzyme comprises, consists essentially of or consists of modification in any one (single), two (double), three (triple), four (quadruple) or more position(s) in accordance with the disclosure throughout this application, or a corresponding residue or position in the CRISPR enzyme orthologue, e.g., an enzyme comprising, consisting essentially of or consisting of modification in any one of the Cpf1 residues recited herein, or a corresponding residue or position in the CRISPR enzyme orthologue. In such an enzyme, each residue may be modified by substitution with an alanine residue.

Applicants recently described a method for the generation of Cas9 orthologues with enhanced specificity (Slaymaker et al. 2015 "Rationally engineered Cas9 nucleases with improved specificity"). This strategy can be used to enhance the specificity of Cpf1 orthologues. Primary residues for mutagenesis are preferably all positive charges residues within the RuvC domain. Additional residues are positive charged residues that are conserved between different orthologues.

In certain embodiments, specificity of Cpf1 may be improved by mutating residues that stabilize the non-targeted DNA strand.

In certain of the above-described non-naturally-occurring Cpf1 enzymes, the enzyme is modified by mutation of one or more residues (in the RuvC domain) including but not limited positions R909, R912, R930, R947, K949, R951, R955, K965, K968, K1000, K1002, R1003, K1009, K1017, K1022, K1029, K1035, K1054, K1072, K1086, R1094, K1095, K1109, K1118, K1142, K1150, K1158, K1159, R1220, R1226, R1242, and/or R1252 with reference to amino acid position numbering of AsCpf1 (*Acidaminococcus* sp. BV3L6).

In certain of the above-described non-naturally-occurring Cpf1 enzymes, the enzyme is modified by mutation of one or more residues (in the RAD50) domain including but not limited positions K324, K335, K337, R331, K369, K370, R386, R392, R393, K400, K404, K406, K408, K414, K429, K436, K438, K459, K460, K464, R670, K675, R681, K686, K689, R699, K705, R725, K729, K739, K748, and/or K752 with reference to amino acid position numbering of AsCpf1 (*Acidaminococcus* sp. BV3L6).

In certain of the above-described non-naturally-occurring Cpf1 enzymes, the enzyme is modified by mutation of one or more residues including but not limited positions R912, T923, R947, K949, R951, R955, K965, K968, K1000, R1003, K1009, K1017, K1022, K1029, K1072, K1086, F1103, R1226, and/or R1252 with reference to amino acid position numbering of AsCpf1 (*Acidaminococcus* sp. BV3L6).

In certain embodiments, the enzyme is modified by mutation of one or more residues including but not limited positions R833, R836, K847, K879, K881, R883, R887, K897, K900, K932, R935, K940, K948, K953, K960, K984, K1003, K1017, R1033, R1138, R1165, and/or R1252 with reference to amino acid position numbering of LbCpf1 (*Lachnospiraceae bacterium* ND2006).

In certain embodiments, the Cpf1 enzyme is modified by mutation of one or more residues including but not limited positions K15, R18, K26, Q34, R43, K48, K51, R56, R84, K85, K87, N93, R103, N104, T118, K123, K134, R176, K177, R192, K200, K226, K273, K275, T291, R301, K307, K369, S404, V409, K414, K436, K438, K468, D482, K516, R518, K524, K530, K532, K548, K559, K570, R574, K592, D596, K603, K607, K613, C647, R681, K686, H720, K739, K748, K757, T766, K780, R790, P791, K796, K809, K815, T816, K860, R862, R863, K868, K897, R909, R912, T923, R947, K949, R951, R955, K965, K968, K1000, R1003, K1009, K1017, K1022, K1029, A1053, K1072, K1086, F1103, S1209, R1226, R1252, K1273, K1282, and/or K1288 with reference to amino acid position numbering of AsCpf1 (*Acidaminococcus* sp. BV3L6).

In certain embodiments, the Cpf1 enzyme is modified by mutation of one or more residues including but not limited positions K15, R18, K26, R34, R43, K48, K51, K56, K87, K88, D90, K96, K106, K107, K120, Q125, K143, R186, K187, R202, K210, K235, K296, K298, K314, K320, K326, K397, K444, K449, E454, A483, E491, K527, K541, K581, R583, K589, K595, K597, K613, K624, K635, K639, K656, K660, K667, K671, K677, K719, K725, K730, K763, K782, K791, R800, K809, K823, R833, K834, K839, K852, K858, K859, K869, K871, R872, K877, K905, R918, R921, K932, I960, K962, R964, R968, K978, K981, K1013, R1016, K1021, K1029, K1034, K1041, K1065, K1084, and/or K1098 with reference to amino acid position numbering of FnCpf1 (*Francisella novicida* U112).

In certain embodiments, the Cpf1 enzyme is modified by mutation of one or more residues including but not limited positions K15, R18, K26, K34, R43, K48, K51, R56, K83, K84, R86, K92, R102, K103, K116, K121, R158, E159, R174, R182, K206, K251, K253, K269, K271, K278, P342, K380, R385, K390, K415, K421, K457, K471, A506, R508, K514, K520, K522, K538, Y548, K560, K564, K580, K584, K591, K595, K601, K634, K640, R645, K679, K689, K707, T716, K725, R737, R747, R748, K753, K768, K774, K775, K785, K787, R788, Q793, K821, R833, R836, K847, R879, K881, R883, R887, K897, K900, K932, R935, K940, K948, K953, K960, K984, K1003, K1017, R1033, K1121, R1138, R1165, K1190, K1199, and/or K1208 with reference to amino acid position numbering of LbCpf1 (*Lachnospiraceae bacterium* ND2006).

In certain embodiments, the enzyme is modified by mutation of one or more residues including but not limited positions K14, R17, K25, K33, M42, Q47, K50, D55, K85, N86, K88, K94, R104, K105, K118, K123, K131, R174, K175, R190, R198, I221, K267, Q269, K285, K291, K297, K357, K403, K409, K414, K448, K460, K501, K515, K550, R552, K558, K564, K566, K582, K593, K604, K608, K623, K627, K633, K637, E643, K780, Y787, K792, K830, Q846, K858, K867, K876, K890, R900, K901, M906, K921, K927, K928, K937, K939, R940, K945, Q975, R987, R990, K1001, R1034, I1036, R1038, R1042, K1052, K1055, K1087, R1090, K1095, N1103, K1108, K1115, K1139, K1158, R1172, K1188, K1276, R1293, A1319, K1340, K1349, and/or K1356 with reference to amino acid position numbering of MbCpf1 (*Moraxella bovoculi* 237).

In any of the non-naturally-occurring CRISPR enzymes:
a single mismatch may exist between the target and a corresponding sequence of the one or more off-target loci; and/or two, three or four or more mismatches may exist between the target and a corresponding sequence of the one or more off-target loci, and/or wherein in (ii) said two, three or four or more mismatches are contiguous.

In an aspect, the invention provides CRISPR nucleases as defined herein, such as Cpf1, that comprise an improved equilibrium towards conformations associated with cleavage activity when involved in on-target interactions and/or improved equilibrium away from conformations associated with cleavage activity when involved in off-target interactions. In one aspect, the invention provides Cas (e.g. Cpf1) nucleases with improved proof-reading function, i.e. a Cas (e.g. Cpf1) nuclease which adopts a conformation comprising nuclease activity at an on-target site, and which conformation has increased unfavorability at an off-target site. Sternberg et al., Nature 527(7576):110-3, doi: 10.1038/nature15544, published online 28 Oct. 2015. Epub 2015 Oct. 28, used Forster resonance energy transfer FRET) experiments to detect relative orientations of the Cas (e.g. Cpf1) catalytic domains when associated with on- and off-target DNA, and which may be extrapolated to the CRISPR enzymes of the present invention (e.g. Cpf1).

The invention further provides methods and mutations for modulating nuclease activity and/or specificity using modified guide RNAs. As discussed, on-target nuclease activity can be increased or decreased. Also, off-target nuclease activity can be increased or decreased. Further, there can be increased or decreased specificity as to on-target activity vs. off-target activity. Modified guide RNAs include, without limitation, truncated guide RNAs, dead guide RNAs, chemically modified guide RNAs, guide RNAs associated with functional domains, modified guide RNAs comprising functional domains, modified guide RNAs comprising aptamers, modified guide RNAs comprising adapter proteins, and guide RNAs comprising added or modified loops. In some embodiments, one or more functional domains are associated with an dead gRNA (dRNA). In some embodiments, a dRNA complex with the CRISPR enzyme directs gene regulation by a functional domain at on gene locus while an gRNA directs DNA cleavage by the CRISPR enzyme at another locus. In some embodiments, dRNAs are selected to maximize selectivity of regulation for a gene locus of interest compared to off-target regulation. In some embodiments, dRNAs are selected to maximize target gene regulation and minimize target cleavage.

In an aspect, the invention also provides methods and mutations for modulating Cas (e.g. Cpf1) binding activity and/or binding specificity. In certain embodiments Cas (e.g. Cpf1) proteins lacking nuclease activity are used. In certain embodiments, modified guide RNAs are employed that promote binding but not nuclease activity of a Cas (e.g. Cpf1) nuclease. In such embodiments, on-target binding can be increased or decreased. Also, in such embodiments off-target binding can be increased or decreased. Moreover, there can be increased or decreased specificity as to on-target binding vs. off-target binding.

The methods and mutations which can be employed in various combinations to increase or decrease activity and/or specificity of on-target vs. off-target activity, or increase or decrease binding and/or specificity of on-target vs. off-target binding, can be used to compensate or enhance mutations or modifications made to promote other effects. Such mutations or modifications made to promote other effects in include mutations or modification to the Cas (e.g. Cpf1) and or mutation or modification made to a guide RNA. In certain embodiments, the methods and mutations are used with chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs futher include, without limitation, RNAs with phosphorothioate linkages and locked nucleic acid (LNA) nucleotides comprising a methylene bridge between the 2' and 4' carbons of the ribose ring. The methods and mutations of the invention are used to modulate Cas (e.g. Cpf1) nuclease activity and/or binding with chemically modified guide RNAs.

The use of Cas (e.g. Cpf1) as an RNA-guided binding protein is not limited to nuclease-null Cas (e.g. Cpf1). Cas (e.g. Cpf1) enzymes comprising nuclease activity can also function as RNA-guided binding proteins when used with certain guide RNAs. For example short guide RNAs and guide RNAs comprising nucleotides mismatched to the target can promote RNA directed Cas (e.g. Cpf1) binding to a target sequence with little or no target cleavage. (See, e.g., Dahlman, 2015, Nat Biotechnol. 33(11):1159-1161, doi: 10.1038/nbt.3390, published online 5 Oct. 2015). In an aspect, the invention provides methods and mutations for modulating binding of Cas (e.g. Cpf1) proteins that comprise nuclease activity. In certain embodiments, on-target binding is increased. In certain embodiments, off-target binding is decreased. In certain embodiments, on-target binding is decreased. In certain embodiments, off-target binding is increased. In certain embodiments, there is increased or decreased specificity of on-target binding vs. off-target binding. In certain embodiments, nuclease activity of guide RNA-Cas (e.g. Cpf1) enzyme is also modulated.

RNA-DNA heteroduplex formation is important for cleavage activity and specificity throughout the target region, not only the seed region sequence closest to the PAM. Thus, truncated guide RNAs show reduced cleavage activity and specificity. In an aspect, the invention provides method and mutations for increasing activity and specificity of cleavage using altered guide RNAs.

The invention also demonstrates that modifications of Cas (e.g. Cpf1) nuclease specificity can be made in concert with modifications to targeting range. Cas (e.g. Cpf1) mutants can be designed that have increased target specificity as well as accommodating modifications in PAM recognition, for example by choosing mutations that alter PAM specificity and combining those mutations with nt-groove mutations that increase (or if desired, decrease) specificity for on-target sequences vs. off-target sequences. In one such embodiment, a PI domain residue is mutated to accommodate recognition of a desired PAM sequence while one or more nt-groove amino acids is mutated to alter target specificity. The Cas (e.g. Cpf1) methods and modifications described herein can be used to counter loss of specificity resulting from alteration of PAM recognition, enhance gain of specificity resulting from alteration of PAM recognition, counter gain of specificity resulting from alteration of PAM recognition, or enhance loss of specificity resulting from alteration of PAM recognition.

The methods and mutations can be used with any Cas (e.g. Cpf1) enzyme with altered PAM recognition. Non-limiting examples of PAMs included are as described herein elsewhere. In any of the non-naturally-occurring CRISPR enzymes, the CRISPR enzyme may comprise one or more heterologous functional domains as described elsewhere herein.

In any of the non-naturally-occurring CRISPR enzymes, the CRISPR enzyme may comprise a CRISPR enzyme from an organism from a genus comprising *Francisella tularensis* 1, *Francisella tularensis* subsp. *novicida*, *Prevotella albensis*, *Lachnospiraceae bacterium* MC2017 1, *Butyrivibrio proteoclasticus*, *Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens*, or *Porphyromonas macacae* (e.g., a Cpf1 of one of these organisms modified as described herein), and may include further mutations or alterations or be a chimeric Cas (e.g. Cpf1).

In any of the non-naturally-occurring CRISPR enzymes, the CRISPR enzyme may comprise a chimeric Cas (e.g. Cpf1) enzyme comprising a first fragment from a first Cas (e.g. Cpf1) ortholog and a second fragment from a second Cas (e.g. Cpf1) ortholog, and the first and second Cas (e.g. Cpf1) orthologs are different. At least one of the first and second Cas (e.g. Cpf1) orthologs may comprise a Cas (e.g. Cpf1) from an organism comprising *Francisella tularensis* 1, *Francisella tularensis* subsp. *novicida*, *Prevotella albensis*, *Lachnospiraceae bacterium* MC2017 1, *Butyrivibrio proteoclasticus*, *Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens*, or *Porphyromonas macacae*.

In certain embodiments, the methods as described herein may comprise providing a Cas (e.g. Cpf1) transgenic cell in which one or more nucleic acids encoding one or more guide RNAs are provided or introduced operably connected in the cell with a regulatory element comprising a promoter of one or more gene of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way how the Cas transgene is introduced in the cell is may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo Biosciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference, and which can be extrapolated to the CRISPR enzymes of the present invention as defined herein. The Cas transgene can further comprise a Lox-Stop-polyA-Lox (LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus, such as for instance one or more oncogenic mutations, as for instance and without limitation described in Platt et al. (2014), Chen et al., (2014) or Kumar et al. (2009).

The invention also provides an engineered, non-naturally occurring Clustered Regularly Interspersed Short Palindromic Repeats (CRISPR)-CRISPR associated (Cas) (CRISPR-Cas) vector system comprising one or more vectors comprising:
  a) a first regulatory element operably linked to a nucleotide sequence encoding a non-naturally-occurring CRISPR enzyme of any one of the inventive constructs herein; and
  b) a second regulatory element operably linked to one or more nucleotide sequences encoding one or more of the guide RNAs, the guide RNA comprising a guide sequence, a direct repeat sequence,
wherein:
  components (a) and (b) are located on same or different vectors,
    the CRISPR complex is formed;
    the guide RNA targets the target polynucleotide loci and the enzyme alters the polynucleotide loci, and
    the enzyme in the CRISPR complex has reduced capability of modifying one or more off-target loci as compared to an unmodified enzyme and/or whereby the enzyme in the CRISPR complex has increased capability of modifying the one or more target loci as compared to an unmodified enzyme.

In such a system, component (II) may comprise a first regulatory element operably linked to a polynucleotide sequence which comprises the guide sequence, the direct repeat sequence, and wherein component (II) may comprise a second regulatory element operably linked to a polynucleotide sequence encoding the CRISPR enzyme. In such a system, where applicable the guide RNA may comprise a chimeric RNA.

In such a system, component (I) may comprise a first regulatory element operably linked to the guide sequence and the direct repeat sequence, and wherein component (II) may comprise a second regulatory element operably linked to a polynucleotide sequence encoding the CRISPR enzyme. Such a system may comprise more than one guide RNA, and each guide RNA has a different target whereby there is multiplexing. Components (a) and (b) may be on the same vector.

The invention also provides a method of modifying a locus of interest in a cell comprising contacting the cell with any of the herein-described engineered CRISPR enzymes (e.g. engineered Cpf1), compositions or any of the herein-described systems or vector systems, or wherein the cell comprises any of the herein-described CRISPR complexes present within the cell. In such methods the cell may be a prokaryotic or eukaryotic cell, preferably a eukaryotic cell. In such methods, an organism may comprise the cell. In such methods the organism may not be a human or other animal.

The invention also provides the use of any of the engineered CRISPR enzymes (e.g. engineered Cpf1), compositions, systems or CRISPR complexes described above for gene or genome editing.

The invention also provides a method of altering the expression of a genomic locus of interest in a mammalian cell comprising contacting the cell with the engineered CRISPR enzymes (e.g. engineered Cpf1), compositions, systems or CRISPR complexes described herein and thereby delivering the CRISPR-Cas (vector) and allowing the CRISPR-Cas complex to form and bind to target, and determining if the expression of the genomic locus has been altered, such as increased or decreased expression, or modification of a gene product.

The invention also provides any of the engineered CRISPR enzymes (e.g. engineered Cpf1), compositions, systems or CRISPR complexes described above for use as a therapeutic. The therapeutic may be for gene or genome editing, or gene therapy. In particular embodiments, the target sequence in a genomic locus of interest, is in a HSC (hematopoietic stemm cell), wherein the genomic locus of interest is associated with a mutation associated with an aberrant protein expression or with a disease condition or state.

In one aspect, the invention provides a method of modifying an organism or a non-human organism by manipulation of a target sequence in a genomic locus of interest of for instance an HSC (hematopoietic stem cell), e.g., wherein the genomic locus of interest is associated with a mutation associated with an aberrant protein expression or with a disease condition or state, comprising:
  delivering to an HSC, e.g., via contacting an HSC with a particle containing, a non-naturally occurring or engineered composition comprising:
    I. a CRISPR-Cas system guide RNA (gRNA) polynucleotide sequence, comprising:
      (a) a guide sequence capable of hybridizing to a target sequence in a HSC,
      (b) a direct repeat sequence, and
    II. a CRISPR enzyme, optionally comprising at least one or more nuclear localization sequences,
      wherein, the guide sequence directs sequence-specific binding of a CRISPR complex to the target sequence, and
      wherein the CRISPR complex comprises the CRISPR enzyme complexed with (1) the guide sequence that is hybridized to the target sequence; and
      the method may optionally include also delivering a HDR template, e.g., via the particle contacting the HSC containing or contacting the HSC with another particle containing, the HDR template wherein the HDR template provides expression of a normal or less aberrant form of the protein; wherein "normal" is as to wild type, and "aberrant" can be a protein expression that gives rise to a condition or disease state; and
      optionally the method may include isolating or obtaining HSC from the organism or non-human organism, optionally expanding the HSC population, performing contacting of the particle(s) with the HSC to obtain a modified HSC population, optionally expanding the population of modified HSCs, and optionally administering modified HSCs to the organism or non-human organism.

In one aspect, the invention provides a method of modifying an organism or a non-human organism by manipulation of a target sequence in a genomic locus of interest of for instance a HSC, e.g., wherein the genomic locus of interest is associated with a mutation associated with an aberrant protein expression or with a disease condition or state, comprising: delivering to an HSC, e.g., via contacting an HSC with a particle containing, a non-naturally occurring or engineered composition comprising: I. (a) a guide sequence capable of hybridizing to a target sequence in a HSC, and (b) at least one or more direct repeat sequences, and II. a CRISPR enzyme optionally having one or more NLSs, and the guide sequence directs sequence-specific binding of a CRISPR complex to the target sequence, and wherein the CRISPR complex comprises the CRISPR enzyme complexed with the guide sequence that is hybridized to the target sequence; and the method may optionally include also delivering a HDR template, e.g., via the particle contacting the HSC containing or contacting the HSC with another particle containing, the HDR template wherein the HDR template provides expression of a normal or less aberrant form of the protein; wherein "normal" is as to wild type, and "aberrant" can be a protein expression that gives rise to a condition or disease state; and optionally the method may include isolating or obtaining HSC from the organism or non-human organism, optionally expanding the HSC population, performing contacting of the particle(s) with the HSC to obtain a modified HSC population, optionally expanding the population of modified HSCs, and optionally administering modified HSCs to the organism or non-human organism.

The delivery can be of one or more polynucleotides encoding any one or more or all of the CRISPR-complex, advantageously linked to one or more regulatory elements for in vivo expression, e.g. via particle(s), containing a vector containing the polynucleotide(s) operably linked to the regulatory element(s). Any or all of the polynucleotide sequence encoding a CRISPR enzyme, guide sequence, direct repeat sequence, may be RNA. It will be appreciated that where reference is made to a polynucleotide, which is RNA and is said to 'comprise' a feature such a direct repeat sequence, the RNA sequence includes the feature. Where the polynucleotide is DNA and is said to comprise a feature such a direct repeat sequence, the DNA sequence is or can be transcribed into the RNA including the feature at issue. Where the feature is a protein, such as the CRISPR enzyme, the DNA or RNA sequence referred to is, or can be, translated (and in the case of DNA transcribed first).

In certain embodiments the invention provides a method of modifying an organism, e.g., mammal including human or a non-human mammal or organism by manipulation of a target sequence in a genomic locus of interest of an HSC e.g., wherein the genomic locus of interest is associated with a mutation associated with an aberrant protein expression or with a disease condition or state, comprising delivering, e.g., via contacting of a non-naturally occurring or engineered composition with the HSC, wherein the composition comprises one or more particles comprising viral, plasmid or nucleic acid molecule vector(s) (e.g. RNA) operably encoding a composition for expression thereof, wherein the composition comprises: (A) I. a first regulatory element operably linked to a CRISPR-Cas system RNA polynucleotide sequence, wherein the polynucleotide sequence comprises (a) a guide sequence capable of hybridizing to a target sequence in a eukaryotic cell, (b) a direct repeat sequence and II. a second regulatory element operably linked to an enzyme-coding sequence encoding a CRISPR enzyme comprising at least one or more nuclear localization sequences (or optionally at least one or more nuclear localization sequences as some embodiments can involve no NLS), wherein (a), (b) and (c) are arranged in a 5' to 3' orientation, wherein components I and II are located on the same or different vectors of the system, wherein when transcribed and the guide sequence directs sequence-specific binding of a CRISPR complex to the target sequence, and wherein the CRISPR complex comprises the CRISPR enzyme complexed with the guide sequence that is hybridized to the target sequence, or (B) a non-naturally occurring or engineered composition comprising a vector system comprising one or more vectors comprising I. a first regulatory element operably linked to (a) a guide sequence capable of hybridizing to a target sequence in a eukaryotic cell, and (b) at least one or more direct repeat sequences, II. a second regulatory element operably linked to an enzyme-coding sequence encoding a CRISPR enzyme, and optionally, where applicable, wherein components I, and II are located on the same or different vectors of the system, wherein when transcribed and the guide sequence directs sequence-specific binding of a CRISPR complex to the target sequence, and wherein the CRISPR complex comprises the CRISPR enzyme complexed with the guide sequence that is hybridized to the target sequence; the method may optionally include also delivering a HDR template, e.g., via the particle contacting the HSC containing or contacting the HSC with another particle containing, the HDR template wherein the HDR template provides expression of a normal or less aberrant form of the protein; wherein "normal" is as to wild type, and "aberrant" can be a protein expression that gives rise to a condition or disease state; and optionally the method may include isolating or obtaining HSC from the organism or non-human organism, optionally expanding the HSC population, performing contacting of the particle(s) with the HSC to obtain a modified HSC population, optionally expanding the population of modified HSCs, and optionally administering modified HSCs to the organism or non-human organism. In some embodiments, components I, II and III are located on the same vector. In other embodiments, components I and II are located on the same vector, while component III is located on another vector. In other embodiments, components I and III are located on the same vector, while component II is located on another vector. In other embodiments, components II and III are located on the same vector, while component I is located on another vector. In other embodiments, each of components I, II and III is located on different vectors. The invention also provides a viral or plasmid vector system as described herein.

By manipulation of a target sequence, Applicants also mean the epigenetic manipulation of a target sequence. This may be f the chromatin state of a target sequence, such as by modification of the methylation state of the target sequence (i.e. addition or removal of methylation or methylation patterns or CpG islands), histone modification, increasing or reducing accessibility to the target sequence, or by promoting 3D folding. It will be appreciated that where reference is made to a method of modifying an organism or mammal including human or a non-human mammal or organism by manipulation of a target sequence in a genomic locus of interest, this may apply to the organism (or mammal) as a whole or just a single cell or population of cells from that organism (if the organism is multicellular). In the case of humans, for instance, Applicants envisage, inter alia, a single cell or a population of cells and these may preferably be modified ex vivo and then re-introduced. In this case, a biopsy or other tissue or biological fluid sample may be necessary. Stem cells are also particularly preferred in this regard. But, of course, in vivo embodiments are also envisaged. And the invention is especially advantageous as to HSCs.

The invention in some embodiments comprises a method of modifying an organism or a non-human organism by manipulation of a first and a second target sequence on opposite strands of a DNA duplex in a genomic locus of interest in a HSC e.g., wherein the genomic locus of interest is associated with a mutation associated with an aberrant protein expression or with a disease condition or state, comprising delivering, e.g., by contacting HSCs with particle(s) comprising a non-naturally occurring or engineered composition comprising:

I. a first CRISPR-Cas (e.g. Cpf1) system RNA polynucleotide sequence, wherein the first polynucleotide sequence comprises:
(a) a first guide sequence capable of hybridizing to the first target sequence,
(b) a first direct repeat sequence, and
II. a second CRISPR-Cas (e.g. Cpf1) system guide RNA polynucleotide sequence, wherein the second polynucleotide sequence comprises:
(a) a second guide sequence capable of hybridizing to the second target sequence,
(b) a second direct repeat sequence, and
III. a polynucleotide sequence encoding a CRISPR enzyme comprising at least one or more nuclear localization sequences and comprising one or more mutations, wherein (a), (b) and (c) are arranged in a 5' to 3' orientation; or
IV. expression product(s) of one or more of I. to III., e.g., the first and the second direct repeat sequence, the CRISPR enzyme;
wherein when transcribed, the first and the second guide sequence directs sequence-specific binding of a first and a second CRISPR complex to the first and second target sequences respectively, wherein the first CRISPR complex comprises the CRISPR enzyme complexed with (1) the first guide sequence that is hybridized to the first target sequence, wherein the second CRISPR complex comprises the CRISPR enzyme complexed with (1) the second guide sequence that is hybridized to the second target sequence, wherein the polynucleotide sequence encoding a CRISPR enzyme is DNA or RNA, and wherein the first guide sequence directs cleavage of one strand of the DNA duplex near the first target sequence and the second guide sequence directs cleavage of the other strand near the second target sequence inducing a double strand break, thereby modifying the organism or the non-human organism; and the method may optionally include also delivering a HDR template, e.g., via the particle contacting the HSC containing or contacting the HSC with another particle containing, the HDR template wherein the HDR template provides expression of a normal or less aberrant form of the protein; wherein "normal" is as to wild type, and "aberrant" can be a protein expression that gives rise to a condition or disease state; and optionally the method may include isolating or obtaining HSC from the organism or non-human organism, optionally expanding the HSC population, performing contacting of the particle(s) with the HSC to obtain a modified HSC population, optionally expanding the population of modified HSCs, and optionally administering modified HSCs to the organism or non-human organism. In some methods of the invention any or all of the polynucleotide sequence encoding the CRISPR enzyme, the first and the second guide sequence, the first and the second direct repeat sequence. In further embodiments of the invention the polynucleotides encoding the sequence encoding the CRISPR enzyme, the first and the second guide sequence, the first and the second direct repeat sequence, is/are RNA and are delivered via liposomes, nanoparticles, exosomes, microvesicles, or a gene-gun; but, it is advantageous that the delivery is via a particle. In certain embodiments of the invention, the first and second direct repeat sequence share 100% identity. In some embodiments, the polynucleotides may be comprised within a vector system comprising one or more vectors. In preferred embodiments, the first CRISPR enzyme has one or more mutations such that the enzyme is a complementary strand nicking enzyme, and the second CRISPR enzyme has one or more mutations such that the enzyme is a non-complementary strand nicking enzyme. Alternatively the first enzyme may be a non-complementary strand nicking enzyme, and the second enzyme may be a complementary strand nicking enzyme. In preferred methods of the invention the first guide sequence directing cleavage of one strand of the DNA duplex near the first target sequence and the second guide sequence directing cleavage of the other strand near the second target sequence results in a 5' overhang. In embodiments of the invention the 5' overhang is at most 200 base pairs, preferably at most 100 base pairs, or more preferably at most 50 base pairs. In embodiments of the invention the 5' overhang is at least 26 base pairs, preferably at least 30 base pairs or more preferably 34-50 base pairs.

The invention in some embodiments comprises a method of modifying an organism or a non-human organism by manipulation of a first and a second target sequence on opposite strands of a DNA duplex in a genomic locus of interest in for instance a HSC e.g., wherein the genomic locus of interest is associated with a mutation associated with an aberrant protein expression or with a disease condition or state, comprising delivering, e.g., by contacting HSCs with particle(s) comprising a non-naturally occurring or engineered composition comprising:

I. a first regulatory element operably linked to
(a) a first guide sequence capable of hybridizing to the first target sequence, and
(b) at least one or more direct repeat sequences,
II. a second regulatory element operably linked to
(a) a second guide sequence capable of hybridizing to the second target sequence, and
(b) at least one or more direct repeat sequences,
III. a third regulatory element operably linked to an enzyme-coding sequence encoding a CRISPR enzyme (e.g. Cpf1), and
V. expression product(s) of one or more of I. to IV., e.g., the first and the second direct repeat sequence, the CRISPR enzyme;
wherein components I, II, III and IV are located on the same or different vectors of the system, when transcribed, and the first and the second guide sequence direct sequence-specific binding of a first and a second CRISPR complex to the first and second target sequences respectively, wherein the first CRISPR complex comprises the CRISPR enzyme complexed with (1) the first guide sequence that is hybridized to the first target sequence, wherein the second CRISPR complex comprises the CRISPR enzyme complexed with the second guide sequence that is hybridized to the second target sequence, wherein the polynucleotide sequence encoding a CRISPR enzyme is DNA or RNA, and wherein the first guide sequence directs cleavage of one strand of the DNA duplex near the first target sequence and the second guide sequence directs cleavage of the other strand near the second target sequence inducing a double strand break, thereby modifying the organism or the non-human organism; and the method may optionally include also delivering a HDR template, e.g., via the particle contacting the HSC containing or contacting the HSC with another particle containing, the HDR template wherein the HDR template provides expression of a normal or less aberrant form of the protein; wherein "normal" is as to wild type, and "aberrant" can be a protein expression that gives rise to a condition or disease state; and optionally the method may include isolating or obtaining HSC from the organism or non-human organism, optionally expanding the HSC population, performing contacting of the particle(s) with the HSC to obtain a modified HSC population, optionally expanding the population of modified HSCs, and optionally administering modified HSCs to the organism or non-human organism.

The invention also provides a vector system as described herein. The system may comprise one, two, three or four different vectors. Components I, II, III and IV may thus be located on one, two, three or four different vectors, and all combinations for possible locations of the components are herein envisaged, for example: components I, II, III and IV can be located on the same vector; components I, II, III and IV can each be located on different vectors; components I, II, II I and IV may be located on a total of two or three different vectors, with all combinations of locations envisaged, etc. In some methods of the invention any or all of the polynucleotide sequence encoding the CRISPR enzyme, the first and the second guide sequence, the first and the second direct repeat sequence is/are RNA. In further embodiments of the invention the first and second direct repeat sequence share 100% identity. In preferred embodiments, the first CRISPR enzyme has one or more mutations such that the enzyme is a complementary strand nicking enzyme, and the second CRISPR enzyme has one or more mutations such that the enzyme is a non-complementary strand nicking enzyme. Alternatively the first enzyme may be a non-complementary strand nicking enzyme, and the second enzyme may be a complementary strand nicking enzyme. In a further embodiment of the invention, one or more of the viral vectors are delivered via liposomes, nanoparticles, exosomes, microvesicles, or a gene-gun; but, particle delivery is advantageous.

In preferred methods of the invention the first guide sequence directing cleavage of one strand of the DNA duplex near the first target sequence and the second guide sequence directing cleavage of other strand near the second target sequence results in a 5' overhang. In embodiments of the invention the 5' overhang is at most 200 base pairs, preferably at most 100 base pairs, or more preferably at most 50 base pairs. In embodiments of the invention the 5' overhang is at least 26 base pairs, preferably at least 30 base pairs or more preferably 34-50 base pairs.

The invention in some embodiments comprehends a method of modifying a genomic locus of interest in for instance HSC e.g., wherein the genomic locus of interest is associated with a mutation associated with an aberrant protein expression or with a disease condition or state, by introducing into the HSC, e.g., by contacting HSCs with particle(s) comprising, a Cas protein having one or more mutations and two guide RNAs that target a first strand and a second strand of the DNA molecule respectively in the HSC, whereby the guide RNAs target the DNA molecule and the Cas protein nicks each of the first strand and the second strand of the DNA molecule, whereby a target in the HSC is altered; and, wherein the Cas protein and the two guide RNAs do not naturally occur together and the method may optionally include also delivering a HDR template, e.g., via the particle contacting the HSC containing or contacting the HSC with another particle containing, the HDR template wherein the HDR template provides expression of a normal or less aberrant form of the protein; wherein "normal" is as to wild type, and "aberrant" can be a protein expression that gives rise to a condition or disease state; and optionally the method may include isolating or obtaining HSC from the organism or non-human organism, optionally expanding the HSC population, performing contacting of the particle(s) with the HSC to obtain a modified HSC population, optionally expanding the population of modified HSCs, and optionally administering modified HSCs to the organism or non-human organism. In preferred methods of the invention the Cas protein nicking each of the first strand and the second strand of the DNA molecule results in a 5' overhang. In embodiments of the invention the 5' overhang is at most 200 base pairs, preferably at most 100 base pairs, or more preferably at most 50 base pairs. In embodiments of the invention the 5' overhang is at least 26 base pairs, preferably at least 30 base pairs or more preferably 34-50 base pairs. In an aspect of the invention the Cas protein is codon optimized for expression in a eukaryotic cell, preferably a mammalian cell or a human cell. Aspects of the invention relate to the expression of a gene product being decreased or a template polynucleotide being further introduced into the DNA molecule encoding the gene product or an intervening sequence being excised precisely by allowing the two 5' overhangs to reanneal and ligate or the activity or function of the gene product being altered or the expression of the gene product being increased. In an embodiment of the invention, the gene product is a protein.

In an aspect, the invention provides cells which transiently comprise CRISPR systems, or components. For example, CRISPR proteins or enzymes and nucleic acids are transiently provided to a cell and a genetic locus is altered, followed by a decline in the amount of one or more components of the CRISPR system. Subsequently, the cells, progeny of the cells, and organisms which comprise the cells, having acquired a CRISPR mediated genetic alteration, comprise a diminished amount of one or more CRISPR system components, or no longer contain the one or more CRISPR system components. One non-limiting example is a self-inactivating CRISPR-Cas system such as further described herein. Thus, the invention provides cells, and organisms, and progeny of the cells and organisms which comprise one or more CRISPR-Cas system-altered genetic loci, but essentially lack one or more CRISPR system component. In certain embodiments, the CRISPR system components are substantially absent. Such cells, tissues and organisms advantageously comprise a desired or selected genetic alteration but have lost CRISPR-Cas components or remnants thereof that potentially might act non-specifically, lead to questions of safety, or hinder regulatory approval. As well, the invention provides products made by the cells, organisms, and progeny of the cells and organisms. Inducible Cpf1 CRISPR-Cas systems ("Split-Cpf1")

In an aspect the invention provides a non-naturally occurring or engineered inducible Cpf1 CRISPR-Cas system, comprising:

a first Cpf1 fusion construct attached to a first half of an inducible dimer and a second Cpf1 fusion construct attached to a second half of the inducible dimer, wherein the first Cpf1 fusion construct is operably linked to one or more nuclear localization signals, wherein the second Cpf1 fusion construct is operably linked to one or more nuclear export signals, wherein contact with an inducer energy source brings the first and second halves of the inducible dimer together, wherein bringing the first and second halves of the inducible dimer together allows the first and second Cpf1 fusion constructs to constitute a functional Cpf1 CRISPR-Cas system, wherein the Cpf1 CRISPR-Cas system comprises a guide RNA (gRNA) comprising a guide sequence capable of hybridizing to a target sequence in a genomic locus of interest in a cell, and wherein the functional Cpf1 CRISPR-Cas system binds to the target sequence and, optionally, edits the genomic locus to alter gene expression.

In an aspect of the invention in the inducible Cpf1 CRISPR-Cas system, the inducible dimer is or comprises or consists essentially of or consists of an inducible heterodimer. In an aspect, in inducible Cpf1 CRISPR-Cas system, the first half or a first portion or a first fragment of the inducible heterodimer is or comprises or consists of or consists essentially of an FKBP, optionally FKBP12. In an aspect of the invention, in the inducible Cpf1 CRISPR-Cas system, the second half or a second portion or a second fragment of the inducible heterodimer is or comprises or consists of or consists essentially of FRB. In an aspect of the invention, in the inducible Cpf1 CRISPR-Cas system, the arrangement of the first Cpf1 fusion construct is or comprises or consists of or consists essentially of N' terminal Cpf1 part-FRB-NES. In an aspect of the invention, in the inducible Cpf1 CRISPR-Cas system, the arrangement of the first Cpf1 fusion construct is or comprises or consists of or consists essentially of NES-N' terminal Cpf1 part-FRB-NES. In an aspect of the invention, in the inducible Cpf1 CRISPR-Cas system, the arrangement of the second Cpf1 fusion construct is or comprises or consists essentially of or consists of C' terminal Cpf1 part-FKBP-NLS. In an aspect the invention provides in the inducible Cpf1 CRISPR-Cas system, the arrangement of the second Cpf1 fusion construct is or comprises or consists of or consists essentially of NLS-C' terminal Cpf1 part-FKBP-NLS. In an aspect, in inducible Cpf1 CRISPR-Cas system there can be a linker that separates the Cpf1 part from the half or portion or fragment of the inducible dimer. In an aspect, in the inducible Cpf1 CRISPR-Cas system, the inducer energy source is or comprises or consists essentially of or consists of rapamycin. In an aspect, in inducible Cpf1 CRISPR-Cas system, the inducible dimer is an inducible homodimer. In an aspect, in inducible Cpf1 CRISPR-Cas system, the Cpf1 is FnCpf1, AsCpf1 or LbCpf1. In an aspect, in the inducible Cpf1 CRISPR-Cas system, one or more functional domains are associated with one or both parts of the Cpf1, e.g., the functional domains optionally including a transcriptional activator, a transcriptional or a nuclease such as a Fok1 nuclease. In an aspect, in the inducible Cpf1 CRISPR-Cas system, the functional Cpf1 CRISPR-Cas system binds to the target sequence and the enzyme is a dead-Cpf1, optionally having a diminished nuclease activity of at least 97%, or 100% (or no more than 3% and advantageously 0% nuclease activity) as compared with the Cpf1 not having the at least one mutation. The invention further comprehends and an aspect of the invention provides, a polynucleotide encoding the inducible Cpf1 CRISPR-Cas system as herein discussed.

In an aspect, the invention provides a method of treating a subject in need thereof, comprising inducing gene editing by transforming the subject with the polynucleotide as herein discussed or any of the vectors herein discussed and administering an inducer energy source to the subject. The invention also provides a method of treating a subject in need thereof, comprising inducing transcriptional activation or repression by transforming the subject with the polynucleotide herein discussed or any of the vectors herein discussed, wherein said polynucleotide or vector encodes or comprises the catalytically inactive Cpf1 and one or more associated functional domains as herein discussed; the method further comprising administering an inducer energy source to the subject. The invention also provides the polynucleotide herein discussed or any of the vectors herein discussed for use in a method of treating a subject in need thereof comprising inducing transcriptional activation or repression, wherein the method further comprises administering an inducer energy source to the subject.

In an aspect the invention involves a non-naturally occurring or engineered inducible Cpf1 CRISPR-Cas system, comprising a first Cpf1 fusion construct attached to a first half of an inducible heterodimer and a second Cpf1 fusion construct attached to a second half of the inducible heterodimer, wherein the first CPf1 fusion construct is operably linked to one or more nuclear localization signals, wherein the second CPf1 fusion construct is operably linked to a nuclear export signal, wherein contact with an inducer energy source brings the first and second halves of the inducible heterodimer together, wherein bringing the first and second halves of the inducible heterodimer together allows the first and second Cpf1 fusion constructs to constitute a functional Cpf1 CRISPR-Cas system, wherein the Cpf1 CRISPR-Cas system comprises a guide RNA (gRNA) comprising a guide sequence capable of hybridizing to a target sequence in a genomic locus of interest in a cell, and wherein the functional Cpf1 CRISPR-Cas system edits the genomic locus to alter gene expression. In an embodiment of the invention the first half of the inducible heterodimer is FKBP12 and the second half of the inducible heterodimer is FRB. In another embodiment of the invention the inducer energy source is rapamycin.

An inducer energy source may be considered to be simply an inducer or a dimerizing agent. The term 'inducer energy source' is used herein throughout for consistency. The inducer energy source (or inducer) acts to reconstitute the Cpf1. In some embodiments, the inducer energy source brings the two parts of the Cpf1 together through the action of the two halves of the inducible dimer. The two halves of the inducible dimer therefore are brought tougher in the presence of the inducer energy source. The two halves of the dimer will not form into the dimer (dimerize) without the inducer energy source.

Thus, the two halves of the inducible dimer cooperate with the inducer energy source to dimerize the dimer. This in turn reconstitutes the Cpf1 by bringing the first and second parts of the Cpf1 together.

The CRISPR enzyme fusion constructs each comprise one part of the split Cpf1. These are fused, preferably via a linker such as a GlySer linker described herein, to one of the two halves of the dimer. The two halves of the dimer may be substantially the same two monomers that together that form the homodimer, or they may be different monomers that together form the heterodimer. As such, the two monomers can be thought of as one half of the full dimer.

The Cpf1 is split in the sense that the two parts of the Cpf1 enzyme substantially comprise a functioning Cpf1. That Cpf1 may function as a genome editing enzyme (when forming a complex with the target DNA and the guide), such as a nickase or a nuclease (cleaving both strands of the DNA), or it may be a dead-Cpf1 which is essentially a DNA-binding protein with very little or no catalytic activity, due to typically mutation(s) in its catalytic domains.

The two parts of the split Cpf1 can be thought of as the N' terminal part and the C' terminal part of the split Cpf1. The fusion is typically at the split point of the Cpf1. In other words, the C' terminal of the N' terminal part of the split Cpf1 is fused to one of the dimer halves, whilst the N' terminal of the C' terminal part is fused to the other dimer half.

The Cpf1 does not have to be split in the sense that the break is newly created. The split point is typically designed in silico and cloned into the constructs. Together, the two parts of the split Cpf1, the N' terminal and C' terminal parts, form a full Cpf1, comprising preferably at least 70% or more of the wildtype amino acids (or nucleotides encoding them), preferably at least 80% or more, preferably at least 90% or more, preferably at least 95% or more, and most preferably at least 99% or more of the wildtype amino acids (or nucleotides encoding them). Some trimming may be possible, and mutants are envisaged. Non-functional domains may be removed entirely. What is important is that the two parts may be brought together and that the desired Cpf1 function is restored or reconstituted.

The dimer may be a homodimer or a heterodimer.

One or more, preferably two, NLSs may be used in operable linkage to the first Cpf1 construct. One or more, preferably two, NESs may be used in operable linkage to the first Cpf1 construct. The NLSs and/or the NESs preferably flank the split Cpf1-dimer (i.e., half dimer) fusion, i.e., one NLS may be positioned at the N' terminal of the first Cpf1 construct and one NLS may be at the C' terminal of the first Cpf1 construct. Similarly, one NES may be positioned at the N' terminal of the second Cpf1 construct and one NES may be at the C' terminal of the second Cpf1 construct. Where reference is made to N' or C' terminals, it will be appreciated that these correspond to 5' ad 3' ends in the corresponding nucleotide sequence.

A preferred arrangement is that the first Cpf1 construct is arranged 5'-NLS-(N' terminal Cpf1 part)-linker-(first half of the dimer)-NLS-3'. A preferred arrangement is that the second Cpf1 construct is arranged 5'-NES-(second half of the dimer)-linker-(C' terminal Cpf1 part)-NES-3'. A suitable promoter is preferably upstream of each of these constructs. The two constructs may be delivered separately or together.

In some embodiments, one or all of the NES(s) in operable linkage to the second CPf1 construct may be swapped out for an NLS. However, this may be typically not preferred and, in other embodiments, the localization signal in operable linkage to the second Cpf1 construct is one or more NES(s).

It will also be appreciated that the NES may be operably linked to the N' terminal fragment of the split Cpf1 and that the NLS may be operably linked to the C' terminal fragment of the split Cpf1. However, the arrangement where the NLS is operably linked to the N' terminal fragment of the split Cpf1 and that the NES is operably linked to the C' terminal fragment of the split Cpf1 may be preferred.

The NES functions to localize the second Cpf1 fusion construct outside of the nucleus, at least until the inducer energy source is provided (e.g., at least until an energy source is provided to the inducer to perform its function). The presence of the inducer stimulates dimerization of the two Cpf1 fusions within the cytoplasm and makes it thermodynamically worthwhile for the dimerized, first and second, Cpf1 fusions to localize to the nucleus. Without being bound by theory, Applicants believe that the NES sequesters the second Cpf1 fusion to the cytoplasm (i.e., outside of the nucleus). The NLS on the first Cpf1 fusion localizes it to the nucleus. In both cases, Applicants use the NES or NLS to shift an equilibrium (the equilibrium of nuclear transport) to a desired direction. The dimerization typically occurs outside of the nucleus (a very small fraction might happen in the nucleus) and the NLSs on the dimerized complex shift the equilibrium of nuclear transport to nuclear localization, so the dimerized and hence reconstituted Cpf1 enters the nucleus.

Beneficially, Applicants are able to reconstitute function in the split Cpf1. Transient transfection is used to prove the concept and dimerization occurs in the background in the presence of the inducer energy source. No activity is seen with separate fragments of the Cpf1. Stable expression through lentiviral delivery is then used to develop this and show that a split Cpf1 approach can be used.

This present split Cpf1 approach is beneficial as it allows the Cpf1 activity to be inducible, thus allowing for temporal control. Furthermore, different localization sequences may be used (i.e., the NES and NLS as preferred) to reduce background activity from auto-assembled complexes. Tissue specific promoters, for example one for each of the first and second Cpf1 fusion constructs, may also be used for tissue-specific targeting, thus providing spatial control. Two different tissue specific promoters may be used to exert a finer degree of control if required. The same approach may be used in respect of stage-specific promoters or there may a mixture of stage and tissue specific promoters, where one of the first and second Cpf1 fusion constructs is under the control of (i.e. operably linked to or comprises) a tissue-specific promoter, whilst the other of the first and second Cpf1 fusion constructs is under the control of (i.e. operably linked to or comprises) a stage-specific promoter.

Applicants demonstrate that CPf1 can be split into two components, which reconstitute a functional nuclease when brought back together. Employing rapamycin sensitive dimerization domains, Applicants generate a chemically inducible Cpf1 for temporal control of Cpf1-mediated genome editing and transcription modulation. Put another way, Applicants demonstrate that Cpf1 can be rendered chemically inducible by being split into two fragments and that rapamycin-sensitive dimerization domains may be used for controlled reassembly of the Cpf1. Applicants show that the re-assembled Cpf1 may be used to mediate genome editing (through nuclease/nickase activity) as well as transcription modulation (as a DNA-binding domain, the so-called "dead Cpf1").

As such, the use of rapamycin-sensitive dimerization domains is preferred. Reassembly of the Cpf1 is preferred. Reassembly can be determined by restoration of binding activity. Where the Cpf1 is a nickase or induces a double-strand break, suitable comparison percentages compared to a wildtype are described herein.

Rapamycin treatments can last 12 days. The dose can be 200 nM. This temporal and/or molar dosage is an example of an appropriate dose for Human embryonic kidney 293FT (HEK293FT) cell lines and this may also be used in other cell lines. This figure can be extrapolated out for therapeutic use in vivo into, for example, mg/kg. However, it is also envisaged that the standard dosage for administering rapamycin to a subject is used here as well. By the "standard dosage", it is meant the dosage under rapamycin's normal therapeutic use or primary indication (i.e. the dose used when rapamycin is administered for use to prevent organ rejection).

It is noteworthy that the preferred arrangement of Cpf1-FRB/FKBP pieces are separate and inactive until rapamycin-induced dimerization of FRB and FKBP results in reassembly of a functional full-length Cpf1 nuclease. Thus, it is preferred that first Cpf1 fusion construct attached to a first half of an inducible heterodimer is delivered separately and/or is localized separately from the second Cpf1 fusion construct attached to a first half of an inducible heterodimer.

To sequester the Cpf1(N)-FRB fragment in the cytoplasm, where it is less likely to dimerize with the nuclear-localized Cpf1(C)-FKBP fragment, it is preferable to use on Cpf1(N)-FRB a single nuclear export sequence (NES) from the human protein tyrosin kinase 2 (Cpf1(N)-FRB-NES). In the presence of rapamycin, Cpf1(N)-FRB-NES dimerizes with Cpf1(C)-FKBP-2×NLS to reconstitute a complete Cpf1 protein, which shifts the balance of nuclear trafficking toward nuclear import and allows DNA targeting.

High dosage of Cpf1 can exacerbate indel frequencies at off-target (OT) sequences which exhibit few mismatches to the guide strand. Such sequences are especially susceptible, if mismatches are non-consecutive and/or outside of the seed region of the guide. Accordingly, temporal control of Cpf1 activity could be used to reduce dosage in long-term expression experiments and therefore result in reduced off-target indels compared to constitutively active Cpf1.

Viral delivery is preferred. In particular, a lentiviral or AAV delivery vector is envisaged. Applicants generate a split-Cpf1 lentivirus construct, similar to the lentiCRISPR plasmid. The split pieces should be small enough to fit the ~4.7 kb size limitation of AAV.

Applicants demonstrate that stable, low copy expression of split Cpf1 can be used to induce substantial indels at a targeted locus without significant mutation at off-target sites. Applicants clone Cpf1 fragments (2 parts based on split 5, described herein).

A dead Cpf1 may also be used, comprising a VP64 transactivation domain, for example added to Cpf1(C)-FKBP-2×NLS (dead-Cpf1(C)-FKBP-2×NLS-VP64). These fragments reconstitute a catalytically inactive Cpf1-VP64 fusion (dead-Cpf1-VP64). Transcriptional activation is induced by VP64 in the presence of rapamycin to induce the dimerization of the Cpf1(C)-FKBP fusion and the Cpf1(N)-FRB fusion. In other words, Applicants test the inducibility of split dead-Cpf1-VP64 and show that transcriptional activation is induced by split dead-Cpf1-VP64 in the presence of rapamycin. As such, the present inducible Cpf1 may be associated with one or more functional domain, such as a transcriptional activator or repressor or a nuclease (such as Fok1). A functional domain may be bound to or fused with one part of the split Cpf1.

A preferred arrangement is that the first Cpf1 construct is arranged 5'-First Localization Signal-(N' terminal CPf1 part)-linker-(first half of the dimer)-First Localization Signal-3' and the second Cpf1 construct is arranged 5'-Second Localization Signal-(second half of the dimer)-linker-(C' terminal Cpf1 part)-Second Localization Signal-Functional Domain-3'. Here, a functional domain is placed at the 3' end of the second Cpf1 construct. Alternatively, a functional domain may be placed at the 5' end of the first Cpf1 construct. One or more functional domains may be used at the 3' end or the 5' end or at both ends. A suitable promoter is preferably upstream of each of these constructs. The two constructs may be delivered separately or together. The Localization Signals may be an NLS or an NES, so long as they are not inter-mixed on each construct.

In an aspect the invention provides an inducible Cpf1 CRISPR-Cas system wherein the Cpf1 has a diminished nuclease activity of at least 97%, or 100% as compared with the Cpf1 enzyme not having the at least one mutation.

Accordingly, it is also preferred that the Cpf1 is a dead-Cpf1. Ideally, the split should always be so that the catalytic domain(s) are unaffected. For the dead-Cpf1 the intention is that DNA binding occurs, but not cleavage or nickase activity is shown.

In an aspect the invention provides an inducible Cpf1 CRISPR-Cas system as herein discussed wherein one or more functional domains is associated with the Cpf1. This functional domain may be associated with (i.e. bound to or fused with) one part of the split Cpf1 or both. There may be one associated with each of the two parts of the split Cpf1. These may therefore be typically provided as part of the first and/or second Cpf1 fusion constructs, as fusions within that construct. The functional domains are typically fused via a linker, such as GlySer linker, as discussed herein. The one or more functional domains may be transcriptional activation domain or a repressor domain. Although they may be different domains it is preferred that all the functional domains are either activator or repressor and that a mixture of the two is not used. The exemplary numbering provided herein may be in reference to the wildtype protein, preferably the wildtype FnCpf1. However, it is envisaged that mutants of the wildtype Cpf1 such as of FnCpf1 protein can be used. The numbering may also not follow exactly the FnCpf1 numbering as, for instance, some N' or C' terminal truncations or deletions may be used, but this can be addressed using standard sequence alignment tools. Orthologs are also preferred as a sequence alignment tool.

Thus, the split position may be selected using ordinary skill in the art, for instance based on crystal data and/or computational structure predictions.

For example, computational analysis of the primary structure of Cpf1 nucleases reveals three distinct regions. First a C-terminal RuvC like domain, which is the only functional characterized domain. Second a N-terminal alpha-helical region and thirst a mixed alpha and beta region, located between the RuvC like domain and the alpha-helical region. Several small stretches of unstructured regions are predicted within the Cpf1 primary structure. Unstructured regions, which are exposed to the solvent and not conserved within different Cpf1 orthologs, may represent preferred sides for splits.

The following table presents non-limiting potential split regions within As and LbCpf1. A split site within such a region may be opportune.

| Split region | AsCpf1 | LbCpf1 |
| --- | --- | --- |
| 1 | 575-588 | 566-571 |
| 2 | 631-645 | 754-757 |
| 3 | 653-664 | — |
| 4 | 818-844 | — |

For Fn, As and Lb Cpf1 mutants, it should be readily apparent what the corresponding position for a potential split site is, for example, based on a sequence alignment. For non-Fn, As and Lb enzymes one can use the crystal structure of an ortholog if a relatively high degree of homology exists between the ortholog and the intended Cpf1, or one can use computational prediction. Ideally, the split position should be located within a region or loop. Preferably, the split position occurs where an interruption of the amino acid sequence does not result in the partial or full destruction of a structural feature (e.g. alpha-helixes or beta-sheets). Unstructured regions (regions that do not show up in the crystal structure because these regions are not structured enough to be "frozen" in a crystal) are often preferred options. Applicants can for example make splits in unstructured regions that are exposed on the surface of Cpf1.

Applicants can follow the following procedure which is provided as a preferred example and as guidance. Since unstructured regions don't show up in the crystal structure, Applicants cross-reference the surrounding amino acid sequence of the crystal with the primary amino acid sequence of the Cpf1. Each unstructured region can be made of for example about 3 to 10 amino acids, which does not show up in the crystal. Applicants therefore make the split in between these amino acids. To include more potential split sides Applicants include splits located in loops at the outside of Cpf1 using the same criteria as with unstructured regions.

In some embodiments, the split positon is in an outside loop of the Cpf1. In other preferred embodiments, the split position is in an unstructured region of the Cpf1. An unstructured region is typically a highly flexible outside loop whose structure cannot be readily determined from a crystal pattern.

Once the split position has been identified, suitable constructs can be designed.

Splits which keep the two parts (either side of the split) roughly the same length may be advantageous for packing purposes. For example, it is thought to be easier to maintain stoichiometry between both pieces when the transcripts are about the same size.

In certain examples, the N- and C-term pieces of human codon-optimized Cpf1 such as FnCpf1 are fused to FRB and FKBP dimerization domains, respectively. This arrangement may be preferred. They may be switched over (i.e. N' term to FKBP and C' term to FRB).

Linkers such as $(GGGGS)_3$ (SEQ ID NO: 19) are preferably used herein to separate the Cpf1 fragment from the dimerization domain. $(GGGGS)_3$ (SEQ ID NO: 19) is preferable because it is a relatively long linker (15 amino acids). The glycine residues are the most flexible and the serine residues enhance the chance that the linker is on the outside of the protein. $(GGGGS)_6$ (SEQ ID NO: 20) $(GGGGS)_9$ (SEQ ID NO: 21) or $(GGGGS)_{12}$ (SEQ ID NO: 22) may preferably be used as alternatives. Other preferred alternatives are $(GGGGS)_1$ (SEQ ID NO: 789), $(GGGGS)_2$ (SEQ ID NO: 790), $(GGGGS)_4$ (SEQ ID NO: 791), $(GGGGS)_5$ (SEQ ID NO: 792), $(GGGGS)_7$ (SEQ ID NO: 793), $(GGGGS)_8$ (SEQ ID NO: 794), $(GGGGS)_{10}$ (SEQ ID NO: 795), or $(GGGGS)_{11}$ (SEQ ID NO: 796).

For example, $(GGGGS)_3$ (SEQ ID NO: 19) may be included between the N' term Cpf1 fragment and FRB. For example, $(GGGGS)_3$ (SEQ ID NO: 19) may be included between FKB and the C' term Cpf1 fragment.

Alternative linkers are available, but highly flexible linkers are thought to work best to allow for maximum opportunity for the 2 parts of the Cpf1 to come together and thus reconstitute Cpf1 activity. One alternative is that the NLS of nucleoplasmin can be used as a linker.

A linker can also be used between the Cpf1 and any functional domain. Again, a $(GGGGS)_3$ (SEQ ID NO: 19) linker may be used here (or the 6 (SEQ ID NO: 20), 9 (SEQ ID NO: 21), or 12 (SEQ ID NO: 22) repeat versions therefore) or the NLS of nucleoplasmin can be used as a linker between CPf1 and the functional domain.

Alternatives to the FRB/FKBP system are envisaged. For example the ABA and gibberellin system.

Accordingly, preferred examples of the FKBP family are any one of the following inducible systems. FKBP which dimerizes with CalcineurinA (CNA), in the presence of FK506; FKBP which dimerizes with CyP-Fas, in the presence of FKCsA; FKBP which dimerizes with FRB, in the presence of Rapamycin; GyrB which dimerizes with GryB, in the presence of Coumermycin; GAI which dimerizes with GID1, in the presence of Gibberellin; or Snap-tag which dimerizes with HaloTag, in the presence of HaXS.

Alternatives within the FKBP family itself are also preferred. For example, FKBP, which homo-dimerizes (i.e. one FKBP dimerizes with another FKBP) in the presence of FK1012. Thus, also provided is a non-naturally occurring or engineered inducible Cpf1 CRISPR-Cas system, comprising:

a first Cpf1 fusion construct attached to a first half of an inducible homoodimer and a second Cpf1 fusion construct attached to a second half of the inducible homoodimer, wherein the first Cpf1 fusion construct is operably linked to one or more nuclear localization signals, wherein the second Cpf1 fusion construct is operably linked to a (optionally one or more) nuclear export signal(s), wherein contact with an inducer energy source brings the first and second halves of the inducible homoodimer together, wherein bringing the first and second halves of the inducible homoodimer together allows the first and second CPf1 fusion constructs to constitute a functional Cpf1 CRISPR-Cas system, wherein the Cpf1 CRISPR-Cas system comprises a guide RNA (gRNA) comprising a guide sequence capable of hybridizing to a target sequence in a genomic locus of interest in a cell, and wherein the functional Cpf1 CRISPR-Cas system binds to the target sequence and, optionally, edits the genomic locus to alter gene expression.

In one embodiment, the homodimer is preferably FKBP and the inducer energy source is preferably FK1012. In another embodiment, the homodimer is preferably GryB and the inducer energy source is preferably Coumermycin. In another embodiment, the homodimer is preferably ABA and the inducer energy source is preferably Gibberellin.

In other embodiments, the dimer is a heterodimer. Preferred examples of heterodimers are any one of the following inducible systems: FKBP which dimerizes with CalcineurinA (CNA), in the presence of FK506; FKBP which dimerizes with CyP-Fas, in the presence of FKCsA; FKBP which dimerizes with FRB, in the presence of Rapamycin, in the presence of Coumermycin; GAI which dimerizes with GID1, in the presence of Gibberellin; or Snap-tag which dimerizes with HaloTag, in the presence of HaXS.

Applicants envisage FKBP/FRB because it is well characterized and both domains are sufficiently small (<100 amino acids) to assist with packaging. Furthermore, rapamycin has been used for a long time and side effects are well understood. Large dimerization domains (>300 aa) should work too but may require longer linkers to make enable Cpf1 reconstitution.

Paulmurugan and Gambhir (Cancer Res, Aug. 15, 2005 65; 7413) discusses the background to the FRB/FKBP/Rapamycin system. Another useful paper is the article by Crabtree et al. (Chemistry & Biology 13, 99-107, January 2006).

In an example, a single vector, an expression cassette (plasmid) is constructed. gRNA is under the control of a U6 promoter. Two different Cpf1 splits are used. The split Cpf1 construct is based on a first Cpf1 fusion construct, flanked by NLSs, with FKBP fused to C terminal part of the split CPf1 via a GlySer linker; and a second CPf1 fusion construct, flanked by NESs, with FRB fused with the N terminal part of the split CPf1 via a GlySer linker. To separate the first and second Cpf1 fusion constructs, P2A is used splitting on transcription. The Split Cpf1 shows indel formation similar to wildtype in the presence of rapamycin, but markedly lower indel formation than the wildtype in the absence of rapamycin.

Accordingly, a single vector is provided. The vector comprises:
- a first Cpf1 fusion construct attached to a first half of an inducible dimer and
- a second Cpf1 fusion construct attached to a second half of the inducible dimer,
- wherein the first Cpf1 fusion construct is operably linked to one or more nuclear localization signals,
- wherein the second CPf1 fusion construct is operably linked to one or more nuclear export signals,
- wherein contact with an inducer energy source brings the first and second halves of the inducible heterodimer together,
- wherein bringing the first and second halves of the inducible heterodimer together allows the first and second CPf1 fusion constructs to constitute a functional Cpf1 CRISPR-Cas system,
- wherein the Cpf1 CRISPR-Cas system comprises a guide RNA (gRNA) comprising a guide sequence capable of hybridizing to a target sequence in a genomic locus of interest in a cell, and
- wherein the functional Cpf1 CRISPR-Cas system binds to the target sequence and, optionally, edits the genomic locus to alter gene expression. These elements are preferably provided on a single construct, for example an expression cassette.

The first Cpf1 fusion construct is preferably flanked by at least one nuclear localization signal at each end. The second CPf1 fusion construct is preferably flanked by at least one nuclear export signal at each end.

The single vector can comprise a transcript-splitting agent, for example P2A. P2A splits the transcript in two, to separate the first and second CPf1 fusion constructs. The splitting is due to "ribosomal skipping". In essence, the ribosome skips an amino acid during translation, which breaks the protein chain and results in two separate polypeptides/proteins. The single vector is also useful for applications where low background activity is not of concern but a high inducible activity is desired.

One example would be the generation of clonal embryonic stem cell lines. The normal procedure is transient transfection with plasmids encoding wt CPf1 or Cpf1 nickases. These plasmids produce Cpf1 molecules, which stay active for several days and have a higher chance of off target activity. Using the single expression vector for split Cpf1 allows restricting "high" Cpf1 activity to a shorter time window (e.g. one dose of an inducer, such as rapamycin). Without continual (daily) inducer (e.g. rapamycin) treatments the activity of single expression split Cpf1 vectors is low and presents a reduced chance of causing unwanted off target effects.

A peak of induced Cpf1 activity is beneficial in some embodiments and may most easily be brought about using a single delivery vector, but it is also possible through a dual vector system (each vector delivering one half of the split CPf1). The peak may be high activity and for a short timescale, typically the lifetime of the inducer.

Accordingly, provided is a method for generation of clonal embryonic stem cell lines, comprising transfecting one or more embryonic stem cells with a polynucleotide encoding the present system or one of the present vectors to express the present split Cpf1 and administering or contacting the one or more stem cells with the present inducer energy source to induce reconstitution of the Cpf1. A repair template may be provided.

As with all methods described herein, it will be appreciated that suitable gRNA or guides will be required.

Other examples of inducers include light and hormones. For light, the inducible dimers may be heterodimers and include first light-inducible half of a dimer and a second (and complimentary) light-inducible half of a dimer. A preferred example of first and second light-inducible dimer halves is the CIB1 and CRY2 system. The CIB1 domain is a heterodimeric binding partner of the light-sensitive Cryptochrome 2 (CRY2).

In another example, the blue light-responsive Magnet dimerization system (pMag and nMag) may be fused to the two parts of a split Cpf1 protein. In response to light stimulation, pMag and nMag dimerize and Cpf1 reassembles. For example, such system is described in connection with Cas9 in Nihongaki et al. (Nat. Biotechnol. 33, 755-790, 2015).

The invention comprehends that the inducer energy source may be heat, ultrasound, electromagnetic energy or chemical. In a preferred embodiment of the invention, the inducer energy source may be an antibiotic, a small molecule, a hormone, a hormone derivative, a steroid or a steroid derivative. In a more preferred embodiment, the inducer energy source maybe abscisic acid (ABA), doxycycline (DOX), cumate, rapamycin, 4-hydroxytamoxifen (4OHT), estrogen or ecdysone. The invention provides that the at least one switch may be selected from the group consisting of antibiotic based inducible systems, electromagnetic energy based inducible systems, small molecule based inducible systems, nuclear receptor based inducible systems and hormone based inducible systems. In a more preferred embodiment the at least one switch may be selected from the group consisting of tetracycline (Tet)/DOX inducible systems, light inducible systems, ABA inducible systems, cumate repressor/operator systems, 4OHT/estrogen inducible systems, ecdysone-based inducible systems and FKBP12/FRAP (FKBP12-rapamycin complex) inducible systems. Such inducers are also discussed herein and in PCT/US2013/051418, incorporated herein by reference.

In general, any use that can be made of a Cpf1, whether wt, nickase or a dead-Cpf1 (with or without associated functional domains) can be pursued using the present split Cpf1 approach. The benefit remains the inducible nature of the Cpf1 activity.

As a further example, split CPf1 fusions with fluorescent proteins like GFP can be made. This would allow imaging of genomic loci (see "Dynamic Imaging of Genomic Loci in Living Human Cells by an Optimized CRISPR/Cas System" Chen B et al. Cell 2013), but in an inducible manner. As such, in some embodiments, one or more of the Cpf1 parts may be associated (and in particular fused with) a fluorescent protein, for example GFP.

Further experiments address whether there is a difference in off-target cutting, between wild type (wt) and split Cpf1, when on-target cutting is at the same level. To do this, Applicants use transient transfection of wt and split Cpf1 plasmids and harvest at different time points. Applicants look for off-target activatation after finding a set of samples where on-target cutting is within +/−5%. Applicants make cell lines with stable expression of wt or split Cpf1 without guides (using lentivirus). After antibiotic selection, guides are delivered with a separate lentivirus and there is harvest at different time points to measure on-/off-target cutting.

Applicants introduce a destabilizing sequence (PEST, see "Use of mRNA- and protein-destabilizing elements to develop a highly responsive reporter system" Voon D C et al. Nucleic Acids Research 2005) into the FRB(N)Cpf1-NES fragment to facilitate faster degradation and therefore reduced stability of the split dead-Cpf1-VP64 complex.

Such destabilizing sequences as described elsewhere in this specification (including PEST) can be advantageous for use with split Cpf1 systems.

Cell lines stably expressing split dead-Cpf1-VP64 and MS2-p65-HSF1+guide are generated. A PLX resistance screen can demonstrate that a non-reversible, timed transcriptional activation can be useful in drug screens. This approach is may be advantageous when a split dead-Cpf1-VP64 is not reversible.

In one aspect the invention provides a non-naturally occurring or engineered Cpf1 CRISPR-Cas system which may comprise at least one switch wherein the activity of said Cpf1 CRISPR-Cas system is controlled by contact with at least one inducer energy source as to the switch. In an embodiment of the invention the control as to the at least one switch or the activity of said Cpf1 CRISPR-Cas system may be activated, enhanced, terminated or repressed. The contact with the at least one inducer energy source may result in a first effect and a second effect. The first effect may be one or more of nuclear import, nuclear export, recruitment of a secondary component (such as an effector molecule), conformational change (of protein, DNA or RNA), cleavage, release of cargo (such as a caged molecule or a co-factor), association or dissociation. The second effect may be one or more of activation, enhancement, termination or repression of the control as to the at least one switch or the activity of said Cpf1 CRISPR-Cas system. In one embodiment the first effect and the second effect may occur in a cascade.

In another aspect of the invention the Cpf1 CRISPR-Cas system may further comprise at least one or more nuclear localization signal (NLS), nuclear export signal (NES), functional domain, flexible linker, mutation, deletion, alteration or truncation. The one or more of the NLS, the NES or the functional domain may be conditionally activated or inactivated. In another embodiment, the mutation may be one or more of a mutation in a transcription factor homology region, a mutation in a DNA binding domain (such as mutating basic residues of a basic helix loop helix), a mutation in an endogenous NLS or a mutation in an endogenous NES. The invention comprehends that the inducer energy source may be heat, ultrasound, electromagnetic energy or chemical. In a preferred embodiment of the invention, the inducer energy source may be an antibiotic, a small molecule, a hormone, a hormone derivative, a steroid or a steroid derivative. In a more preferred embodiment, the inducer energy source maybe abscisic acid (ABA), doxycycline (DOX), cumate, rapamycin, 4-hydroxytamoxifen (4OHT), estrogen or ecdysone. The invention provides that the at least one switch may be selected from the group consisting of antibiotic based inducible systems, electromagnetic energy based inducible systems, small molecule based inducible systems, nuclear receptor based inducible systems and hormone based inducible systems. In a more preferred embodiment the at least one switch may be selected from the group consisting of tetracycline (Tet)/DOX inducible systems, light inducible systems, ABA inducible systems, cumate repressor/operator systems, 4OHT/estrogen inducible systems, ecdysone-based inducible systems and FKBP12/FRAP (FKBP12-rapamycin complex) inducible systems.

Aspects of control as detailed in this application relate to at least one or more switch(es). The term "switch" as used herein refers to a system or a set of components that act in a coordinated manner to affect a change, encompassing all aspects of biological function such as activation, repression, enhancement or termination of that function. In one aspect the term switch encompasses genetic switches which comprise the basic components of gene regulatory proteins and the specific DNA sequences that these proteins recognize. In one aspect, switches relate to inducible and repressible systems used in gene regulation. In general, an inducible system may be off unless there is the presence of some molecule (called an inducer) that allows for gene expression. The molecule is said to "induce expression". The manner by which this happens is dependent on the control mechanisms as well as differences in cell type. A repressible system is on except in the presence of some molecule (called a corepressor) that suppresses gene expression. The molecule is said to "repress expression". The manner by which this happens is dependent on the control mechanisms as well as differences in cell type. The term "inducible" as used herein may encompass all aspects of a switch irrespective of the molecular mechanism involved. Accordingly a switch as comprehended by the invention may include but is not limited to antibiotic based inducible systems, electromagnetic energy based inducible systems, small molecule based inducible systems, nuclear receptor based inducible systems and hormone based inducible systems. In preferred embodiments the switch may be a tetracycline (Tet)/DOX inducible system, a light inducible systems, a Abscisic acid (ABA) inducible system, a cumate repressor/operator system, a 4OHT/estrogen inducible system, an ecdysone-based inducible systems or a FKBP12/FRAP (FKBP12-rapamycin complex) inducible system.

The present Cpf1 CRISPR-Cas system may be designed to modulate or alter expression of individual endogenous genes in a temporally and spatially precise manner. The Cpf1 CRISPR-Cas system may be designed to bind to the promoter sequence of the gene of interest to change gene expression. The Cpf1 may be spilt into two where one half is fused to one half of the cryptochrome heterodimer (cryptochrome-2 or CIB1), while the remaining cryptochrome partner is fused to the other half of the Cpf1. In some aspects, a transcriptional effector domain may also be included in the Cpf1 CRISPR-Cas system. Effector domains may be either activators, such as VP16, VP64, or p65, or repressors, such as KRAB, EnR, or SID. In unstimulated state, the one half Cpf1-cryptochrome2 protein localizes to the promoter of the gene of interest, but is not bound to the CIB1-effector protein. Upon stimulation with blue spectrum light, cryptochrome-2 becomes activated, undergoes a conformational change, and reveals its binding domain. CIB1, in turn, binds to cryptochrome-2 resulting in localization of the second half of the Cpf1 to the promoter region of the gene of interest and initiating genome editing which may result in gene overexpression or silencing. Aspects of LITEs are further described in Liu, H et al. Science, 2008 and Kennedy M et al., Nature Methods 2010, the contents of which are herein incorporated by reference in their entirety.

There are several different ways to generate chemical inducible systems as well: 1. ABI-PYL based system inducible by Abscisic Acid (ABA) (see, e.g., website at stke.sciencemag.org/cgi/content/abstract/sigtrans; 4/164/rs2), 2. FKBP-FRB based system inducible by rapamycin (or related chemicals based on rapamycin) (see, e.g., website at nature.com/nmeth/journal/v2/n6/full/nmeth763.html), 3. GID1-GAI based system inducible by Gibberellin (GA) (see, e.g., website at nature.com/nchembio/journal/v8/n5/full/nchembio.922.html).

Another system contemplated by the present invention is a chemical inducible system based on change in sub-cellular localization. Applicants also comprehend an inducible Cpf1 CRISPR-Cas system engineered to target a genomic locus of interest wherein the Cpf1 enzyme is split into two fusion constructs that are further linked to different parts of a chemical or energy sensitive protein. This chemical or energy sensitive protein will lead to a change in the sub-cellular localization of either half of the CPf1 enzyme (i.e. transportation of either half of the Cpf1 enzyme from cytoplasm into the nucleus of the cells) upon the binding of a chemical or energy transfer to the chemical or energy sensitive protein. This transportation of fusion constructs from one sub-cellular compartments or organelles, in which its activity is sequestered due to lack of substrate for the reconstituted Cpf1 CRISPR-Cas system, into another one in which the substrate is present would allow the components to come together and reconstitute functional activity and to then come in contact with its desired substrate (i.e. genomic DNA in the mammalian nucleus) and result in activation or repression of target gene expression.

Other inducible systems are contemplated such as, but not limited to, regulation by heavy-metals [Mayo K E et al., Cell 1982, 29:99-108; Searle P F et al., Mol Cell Biol 1985, 5:1480-1489 and Brinster R L et al., Nature (London) 1982, 296:39-42], steroid hormones [Hynes N E et al., Proc Natl Acad Sci USA 1981, 78:2038-2042; Klock G et al., Nature (London) 1987, 329:734-736 and Lee F et al., Nature (London) 1981, 294:228-232.], heat shock [Nouer L: Heat Shock Response. Boca Raton, FL: CRC; 1991] and other reagents have been developed [Mullick A, Massie B: Transcription, translation and the control of gene expression. In Encyclopedia of Cell Technology Edited by: Speir R E. Wiley; 2000:1140-1164 and Fussenegger M. Biotechnol Prog 2001, 17:1-51]. However, there are limitations with these inducible mammalian promoters such as "leakiness" of the "off" state and pleiotropic effects of inducers (heat shock, heavy metals, glucocorticoids etc.). The use of insect hormones (ecdysone) has been proposed in an attempt to reduce the interference with cellular processes in mammalian cells [No D et al., Proc Natl Acad Sci USA 1996, 93:3346-3351]. Another elegant system uses rapamycin as the inducer [Rivera V M et al., Nat Med 1996, 2:1028-1032] but the role of rapamycin as an immunosuppressant was a major limitation to its use in vivo and therefore it was necessary to find a biologically inert compound [Saez E et al., Proc Natl Acad Sci USA 2000, 97:14512-14517] for the control of gene expression.

In particular embodiments, the gene editing systems described herein are placed under the control of a passcode kill switch, which is a mechanisms which efficiently kills the host cell when the conditions of the cell are altered. This is ensured by introducing hybrid LacI-GalR family transcription factors, which require the presence of IPTG to be switched on (Chan et al. 2015 Nature *Nature Chemical Biology* doi:10.1038/nchembio.1979 which can be used to drive a gene encoding an enzyme critical for cell-survival. By combining different transcription factors sensitive to different chemicals, a "code" can be generated, This system can be used to spatially and temporally control the extent of CRISPR-induced genetic modifications, which can be of interest in different fields including therapeutic applications and may also be of interest to avoid the "escape" of GMOs from their intended environment.

Self-Inactivating Systems

Once all copies of a gene in the genome of a cell have been edited, continued CRISRP/Cpf1 expression in that cell is no longer necessary. Indeed, sustained expression would be undesirable in case of off-target effects at unintended genomic sites, etc. Thus time-limited expression would be useful. Inducible expression offers one approach, but in addition Applicants envisage a Self-Inactivating CRISPR-Cpf1 system that relies on the use of a non-coding guide target sequence within the CRISPR vector itself. Thus, after expression begins, the CRISPR system will lead to its own destruction, but before destruction is complete it will have time to edit the genomic copies of the target gene (which, with a normal point mutation in a diploid cell, requires at most two edits). Simply, the self inactivating CRISPR-Cas system includes additional RNA (i.e., guide RNA) that targets the coding sequence for the CRISPR enzyme itself or that targets one or more non-coding guide target sequences complementary to unique sequences present in one or more of the following:
(a) within the promoter driving expression of the non-coding RNA elements,
(b) within the promoter driving expression of the Cpf1 gene,
(c) within 100 bp of the ATG translational start codon in the Cpf1 coding sequence,
(d) within the inverted terminal repeat (iTR) of a viral delivery vector, e.g., in the AAV genome.

Furthermore, that RNA can be delivered via a vector, e.g., a separate vector or the same vector that is encoding the CRISPR complex. When provided by a separate vector, the CRISPR RNA that targets Cpf1 expression can be administered sequentially or simultaneously. When administered sequentially, the CRISPR RNA that targets Cpf1 expression is to be delivered after the CRISPR RNA that is intended for e.g. gene editing or gene engineering. This period may be a period of minutes (e.g. 5 minutes, 10 minutes, 20 minutes, 30 minutes, 45 minutes, 60 minutes). This period may be a period of hours (e.g. 2 hours, 4 hours, 6 hours, 8 hours, 12 hours, 24 hours). This period may be a period of days (e.g. 2 days, 3 days, 4 days, 7 days). This period may be a period of weeks (e.g. 2 weeks, 3 weeks, 4 weeks). This period may be a period of months (e.g. 2 months, 4 months, 8 months, 12 months). This period may be a period of years (2 years, 3 years, 4 years). In this fashion, the Cas enzyme associates with a first gRNA capable of hybridizing to a first target, such as a genomic locus or loci of interest and undertakes the function(s) desired of the CRISPR-Cas system (e.g., gene engineering); and subsequently the Cpf1 enzyme may then associate with the second gRNA capable of hybridizing to the sequence comprising at least part of the Cpf1 or CRISPR cassette. Where the gRNA targets the sequences encoding expression of the Cpf1 protein, the enzyme becomes impeded and the system becomes self inactivating. In the same manner, CRISPR RNA that targets Cpf1 expression applied via, for example liposome, lipofection, nanoparticles, microvesicles as explained herein, may be administered sequentially or simultaneously. Similarly, self-inactivation may be used for inactivation of one or more guide RNA used to target one or more targets.

In some aspects, a single gRNA is provided that is capable of hybridization to a sequence downstream of a CRISPR enzyme start codon, whereby after a period of time there is a loss of the CRISPR enzyme expression. In some aspects, one or more gRNA(s) are provided that are capable of hybridization to one or more coding or non-coding regions of the polynucleotide encoding the CRISPR-Cas system, whereby after a period of time there is a inactivation of one or more, or in some cases all, of the CRISPR-Cas systems. In some aspects of the system, and not to be limited by theory, the cell may comprise a plurality of CRISPR-Cas complexes, wherein a first subset of CRISPR complexes comprise a first gRNA capable of targeting a genomic locus or loci to be edited, and a second subset of CRISPR complexes comprise at least one second gRNA capable of targeting the polynucleotide encoding the CRISPR-Cas system, wherein the first subset of CRISPR-Cas complexes mediate editing of the targeted genomic locus or loci and the second subset of CRISPR complexes eventually inactivate the CRISPR-Cas system, thereby inactivating further CRISPR-Cas expression in the cell.

Thus the invention provides a CRISPR-Cas system comprising one or more vectors for delivery to a eukaryotic cell, wherein the vector(s) encode(s): (i) a CRISPR enzyme, more particularly Cpf1; (ii) a first guide RNA capable of hybridizing to a target sequence in the cell; and (iii) a second guide RNA capable of hybridizing to one or more target sequence(s) in the vector which encodes the CRISPR enzyme, When expressed within the cell, the first guide RNA directs sequence-specific binding of a first CRISPR complex to the target sequence in the cell; the second guide RNA directs sequence-specific binding of a second CRISPR complex to the target sequence in the vector which encodes the CRISPR enzyme; the CRISPR complexes comprise a CRISPR enzyme bound to a guide RNA, whereby a guide RNA can hybridize to its target sequence; and the second CRISPR complex inactivates the CRISPR-Cas system to prevent continued expression of the CRISPR enzyme by the cell.

Further characteristics of the vector(s), the encoded enzyme, the guide sequences, etc. are disclosed elsewhere herein. The system can encode (i) a CRISPR enzyme, more particularly Cpf1; (ii) a first gRNA comprising a sequence capable of hybridizing to a first target sequence in the cell, (iii) a second guide RNA capable of hybridizing to the vector which encodes the CRISPR enzyme. Similarly, the enzyme can include one or more NLS, etc.

The various coding sequences (CRISPR enzyme, guide RNAs) can be included on a single vector or on multiple vectors. For instance, it is possible to encode the enzyme on one vector and the various RNA sequences on another vector, or to encode the enzyme and one gRNA on one vector, and the remaining gRNA on another vector, or any other permutation. In general, a system using a total of one or two different vectors is preferred.

Where multiple vectors are used, it is possible to deliver them in unequal numbers, and ideally with an excess of a vector which encodes the first guide RNA relative to the second guide RNA, thereby assisting in delaying final inactivation of the CRISPR system until genome editing has had a chance to occur.

The first guide RNA can target any target sequence of interest within a genome, as described elsewhere herein. The second guide RNA targets a sequence within the vector which encodes the CRISPR Cas9 enzyme, and thereby inactivates the enzyme's expression from that vector. Thus the target sequence in the vector must be capable of inactivating expression. Suitable target sequences can be, for instance, near to or within the translational start codon for the Cpf1 coding sequence, in a non-coding sequence in the promoter driving expression of the non-coding RNA elements, within the promoter driving expression of the Cpf1 gene, within 100 bp of the ATG translational start codon in the Cpf1 coding sequence, and/or within the inverted terminal repeat (iTR) of a viral delivery vector, e.g., in the AAV genome. A double stranded break near this region can induce a frame shift in the Cpf1 coding sequence, causing a loss of protein expression. An alternative target sequence for the "self-inactivating" guide RNA would aim to edit/inactivate regulatory regions/sequences needed for the expression of the CRISPR-Cpf1 system or for the stability of the vector. For instance, if the promoter for the Cpf1 coding sequence is disrupted then transcription can be inhibited or prevented. Similarly, if a vector includes sequences for replication, maintenance or stability then it is possible to target these. For instance, in a AAV vector a useful target sequence is within the iTR. Other useful sequences to target can be promoter sequences, polyadenlyation sites, etc.

Furthermore, if the guide RNAs are expressed in array format, the "self-inactivating" guide RNAs that target both promoters simultaneously will result in the excision of the intervening nucleotides from within the CRISPR-Cas expression construct, effectively leading to its complete inactivation. Similarly, excision of the intervening nucleotides will result where the guide RNAs target both ITRs, or targets two or more other CRISPR-Cas components simultaneously. Self-inactivation as explained herein is applicable, in general, with CRISPR-Cpf1 systems in order to provide regulation of the CRISPR-Cpf1. For example, self-inactivation as explained herein may be applied to the CRISPR repair of mutations, for example expansion disorders, as explained herein. As a result of this self-inactivation, CRISPR repair is only transiently active.

Addition of non-targeting nucleotides to the 5' end (e.g. 1-10 nucleotides, preferably 1-5 nucleotides) of the "self-inactivating" guide RNA can be used to delay its processing and/or modify its efficiency as a means of ensuring editing at the targeted genomic locus prior to CRISPR-Cpf1 shutdown.

In one aspect of the self-inactivating AAV-CRISPR-Cpf1 system, plasmids that co-express one or more gRNA targeting genomic sequences of interest (e.g. 1-2, 1-5, 1-10, 1-15, 1-20, 1-30) may be established with "self-inactivating" gRNAs that target an LbCpf1 sequence at or near the engineered ATG start site (e.g. within 5 nucleotides, within 15 nucleotides, within 30 nucleotides, within 50 nucleotides, within 100 nucleotides). A regulatory sequence in the U6 promoter region can also be targeted with an gRNA. The U6-driven gRNAs may be designed in an array format such that multiple gRNA sequences can be simultaneously released. When first delivered into target tissue/cells (left cell) gRNAs begin to accumulate while Cpf1 levels rise in the nucleus. Cpf1 complexes with all of the gRNAs to mediate genome editing and self-inactivation of the CRISPR-Cpf1 plasmids.

One aspect of a self-inactivating CRISPR-Cpf1 system is expression of singly or in tandam array format from 1 up to 4 or more different guide sequences; e.g. up to about 20 or about 30 guides sequences. Each individual self inactivating guide sequence may target a different target. Such may be processed from, e.g. one chimeric pol3 transcript. Pol3 promoters such as U6 or H1 promoters may be used. Pol2 promoters such as those mentioned throughout herein. Inverted terminal repeat (iTR) sequences may flank the Pol3 promoter—gRNA(s)-Pol2 promoter—Cpf1. One aspect of a chimeric, tandem array transcript is that one or more guide(s) edit the one or more target(s) while one or more self inactivating guides inactivate the CRISPR/Cpf1 system. Thus, for example, the described CRISPR-Cpf1 system for repairing expansion disorders may be directly combined with the self-inactivating CRISPR-Cpf1 system described herein. Such a system may, for example, have two guides directed to the target region for repair as well as at least a third guide directed to self-inactivation of the CRISPR-Cpf1. Reference is made to Application Ser. No. PCT/US2014/069897, entitled "Compositions And Methods Of Use Of Crispr-Cas Systems In Nucleotide Repeat Disorders," published Dec. 12, 2014 as WO/2015/089351. The guideRNA may be a control guide. For example it may be engineered to target a nucleic acid sequence encoding the CRISPR Enzyme itself, as described in US2015232881A1, the disclosure of which is hereby incorporated by reference. In some embodiments, a system or composition may be provided with just the guideRNA engineered to target the nucleic acid sequence encoding the CRISPR Enzyme. In addition, the system or composition may be provided with the guideRNA engineered to target the nucleic acid sequence encoding the CRISPR Enzyme, as well as nucleic acid sequence encoding the CRISPR Enzyme and, optionally a second guide RNA and, further optionally, a repair template. The second guideRNA may be the primary target of the CRISPR system or composition (such a therapeutic, diagnostic, knock out etc. as defined herein). In this way, the system or composition is self-inactivating. This is exemplified in relation to Cas9 in US2015232881A1 (also published as WO2015070083 (A1) referenced elsewhere herein, and may be extrapolated to Cpf1.

Gene Editing or Altering, a Target Loci with Cpf1

The double strand break or single strand break in one of the strands advantageously should be sufficiently close to target position such that correction occurs. In an embodiment, the distance is not more than 50, 100, 200, 300, 350 or 400 nucleotides. While not wishing to be bound by theory, it is believed that the break should be sufficiently close to target position such that the break is within the region that is subject to exonuclease-mediated removal during end resection. If the distance between the target position and a break is too great, the mutation may not be included in the end resection and, therefore, may not be corrected, as the template nucleic acid sequence may only be used to correct sequence within the end resection region.

In an embodiment, in which a guide RNA and a Type V molecule, in particular Cpf1 or an ortholog or homolog thereof, preferably a Cpf1 nuclease induce a double strand break for the purpose of inducing HDR-mediated correction, the cleavage site is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 1 25, 75 to 100 bp) away from the target position. In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position. In a further embodiment, two or more guide RNAs complexing with Cpf1 or an ortholog or homolog thereof, may be used to induce multiplexed breaks for purpose of inducing HDR-mediated correction. The homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm may not extend into repeated elements. Exemplary homology arm lengths include a least 50, 100, 250, 500, 750 or 1000 nucleotides.

Target position, as used herein, refers to a site on a target nucleic acid or target gene (e.g., the chromosome) that is modified by a Type V, in particular Cpf1 or an ortholog or homolog thereof, preferably Cpf1 molecule-dependent process. For example, the target position can be a modified Cpf1 molecule cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a target sequence (e.g., the sequence to which the guide RNA binds). In an embodiment, a target position is upstream or downstream of a target sequence (e.g., the sequence to which the guide RNA binds).

A template nucleic acid, as that term is used herein, refers to a nucleic acid sequence which can be used in conjunction with a Type V molecule, in particular Cpf1 or an ortholog or homolog thereof, preferably a Cpf1 molecule and a guide RNA molecule to alter the structure of a target position. In an embodiment, the target nucleic acid is modified to have some or all of the sequence of the template nucleic acid, typically at or near cleavage site(s). In an embodiment, the template nucleic acid is single stranded. In an alternate embodiment, the template nuceic acid is double stranded. In an embodiment, the template nucleic acid is DNA, e.g., double stranded DNA. In an alternate embodiment, the template nucleic acid is single stranded DNA.

In an embodiment, the template nucleic acid alters the structure of the target position by participating in homologous recombination. In an embodiment, the template nucleic acid alters the sequence of the target position. In an embodiment, the template nucleic acid results in the incorporation of a modified, or non-naturally occurring base into the target nucleic acid.

The template sequence may undergo a breakage mediated or catalyzed recombination with the target sequence. In an embodiment, the template nucleic acid may include sequence that corresponds to a site on the target sequence that is cleaved by a Cpf1 mediated cleavage event. In an embodiment, the template nucleic acid may include sequence that corresponds to both, a first site on the target sequence that is cleaved in a first Cpf1 mediated event, and a second site on the target sequence that is cleaved in a second Cpf1 mediated event.

In certain embodiments, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In certain embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a target gene may be used to alter the structure of a target sequence. The template sequence may be used to alter an unwanted structure, e.g., an unwanted or mutant nucleotide. The template nucleic acid may include sequence which, when integrated, results in: decreasing the activity of a positive control element; increasing the activity of a positive control element; decreasing the activity of a negative control element; increasing the activity of a negative control element; decreasing the expression of a gene; increasing the expression of a gene; increasing resistance to a disorder or disease; increasing resistance to viral entry; correcting a mutation or altering an unwanted amino acid residue conferring, increasing, abolishing or decreasing a biological property of a gene product, e.g., increasing the enzymatic activity of an enzyme, or increasing the ability of a gene product to interact with another molecule.

The template nucleic acid may include sequence which results in: a change in sequence of 1, 2, 3, 4, 5, 6, 7, 8, 9, 10, 1 1, 12 or more nucleotides of the target sequence. In an embodiment, the template nucleic acid may be 20+/−10, 30+/−10, 40+/−10, 50+/−10, 60+/−10, 70+/−10, 80+/−10, 90+/−10, 100+/−10, 1 10+/−10, 120+/−10, 130+/−10, 140+/−10, 150+/−10, 160+/−10, 170+/−10, 1 80+/−10, 190+/−10, 200+/−10, 210+/−10, of 220+/−10 nucleotides in length. In an embodiment, the template nucleic acid may be 30+/−20, 40+/−20, 50+/−20, 60+/−20, 70+/−20, 80+/−20, 90+/−20, 100+/−20, 1 10+/−20, 120+/−20, 130+/−20, 140+/−20, I 50+/−20, 160+/−20, 170+/−20, 180+/−20, 190+/−20, 200+/−20, 210+/−20, of 220+/−20 nucleotides in length. In an embodiment, the template nucleic acid is 10 to 1,000, 20 to 900, 30 to 800, 40 to 700, 50 to 600, 50 to 500, 50 to 400, 50 to 300, 50 to 200, or 50 to 100 nucleotides in length.

A template nucleic acid comprises the following components: [5' homology arm]-[replacement sequence]-[3' homology arm]. The homology arms provide for recombination into the chromosome, thus replacing the undesired element, e.g., a mutation or signature, with the replacement sequence. In an embodiment, the homology arms flank the most distal cleavage sites. In an embodiment, the 3' end of the 5' homology arm is the position next to the 5' end of the replacement sequence. In an embodiment, the 5' homology arm can extend at least 10, 20, 30, 40, 50, 100, 200, 300, 400, 500, 600, 700, 800, 900, 1000, 1500, or 2000 nucleotides 5' from the 5' end of the replacement sequence. In an embodiment, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, or 2000 nucleotides 3' from the 3' end of the replacement sequence.

In certain embodiments, one or both homology arms may be shortened to avoid including certain sequence repeat elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In certain embodiments, a template nucleic acids for correcting a mutation may designed for use as a single-stranded oligonucleotide. When using a single-stranded oligonucleotide, 5' and 3' homology arms may range up to about 200 base pairs (bp) in length, e.g., at least 25, 50, 75, 100, 125, 150, 175, or 200 bp in length.

Cpf1 Effector Protein Complex System Promoted Non-Homologous End-Joining

In certain embodiments, nuclease-induced non-homologous end-joining (NHEJ) can be used to target gene-specific knockouts. Nuclease-induced NHEJ can also be used to remove (e.g., delete) sequence in a gene of interest. Generally, NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein. The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily be greater than 50 bp, e.g., they can easily reach greater than about 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it may also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Both double strand cleaving Type V molecule, in particular Cpf1 or an ortholog or homolog thereof, preferably Cpf1 molecules and single strand, or nickase, Type V molecule, in particular Cpf1 or an ortholog or homolog thereof, preferably Cpf1 molecules can be used in the methods and compositions described herein to generate NHEJ-mediated indels. NHEJ-mediated indels targeted to the gene, e.g., a coding region, e.g., an early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

In an embodiment, in which a guide RNA and Type V molecule, in particular Cpf1 or an ortholog or homolog thereof, preferably Cpf1 nuclease generate a double strand break for the purpose of inducing NHEJ-mediated indels, a guide RNA may be configured to position one double-strand break in close proximity to a nucleotide of the target position. In an embodiment, the cleavage site may be between 0-500 bp away from the target position (e.g., less than 500, 400, 300, 200, 100, 50, 40, 30, 25, 20, 15, 10, 9, 8, 7, 6, 5, 4, 3, 2 or 1 bp from the target position).

In an embodiment, in which two guide RNAs complexing with Type V molecules, in particular Cpf1 or an ortholog or homolog thereof, preferably Cpf1 nickases induce two single strand breaks for the purpose of inducing NHEJ-mediated indels, two guide RNAs may be configured to position two single-strand breaks to provide for NHEJ repair a nucleotide of the target position.

Cpf1 Effector Protein Complexes can Deliver Functional Effectors

Unlike CRISPR-Cas-mediated gene knockout, which permanently eliminates expression by mutating the gene at the DNA level, CRISPR-Cas knockdown allows for temporary reduction of gene expression through the use of artificial transcription factors. Mutating key residues in both DNA cleavage domains of the Cpf1 protein, such as FnCpf1 protein (e.g. the D917A and H1006A mutations or D908A, E993A, D1263A according to AsCpf1 protein or D832A, E925A, D947A or D1180A according to LbCpf1 protein) results in the generation of a catalytically inactive Cpf1. A catalytically inactive Cpf1 complexes with a guide RNA and localizes to the DNA sequence specified by that guide RNA's targeting domain, however, it does not cleave the target DNA. Fusion of the inactive Cpf1 protein, such as FnCpf1 protein (e.g. the D917A and H1006A mutations) to an effector domain, e.g., a transcription repression domain, enables recruitment of the effector to any DNA site specified by the guide RNA. In certain embodiments, Cpf1 may be fused to a transcriptional repression domain and recruited to the promoter region of a gene. Especially for gene repression, it is contemplated herein that blocking the binding site of an endogenous transcription factor would aid in downregulating gene expression. In another embodiment, an inactive Cpf1 can be fused to a chromatin modifying protein. Altering chromatin status can result in decreased expression of the target gene.

In an embodiment, a guide RNA molecule can be targeted to a known transcription response elements (e.g., promoters, enhancers, etc.), a known upstream activating sequences, and/or sequences of unknown or known function that are suspected of being able to control expression of the target DNA.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced.

In certain embodiments, the CRISPR enzyme comprises one or more mutations selected from the group consisting of D917A, E1006A and D1225A and/or the one or more mutations is in a RuvC domain of the CRISPR enzyme or is a mutation as otherwise as discussed herein. In some embodiments, the CRISPR enzyme has one or more mutations in a catalytic domain, wherein when transcribed, the direct repeat sequence forms a single stem loop and the guide sequence directs sequence-specific binding of a CRISPR complex to the target sequence, and wherein the enzyme further comprises a functional domain. In some embodiments, the functional domain is a transcriptional activation domain, preferably VP64. In some embodiments, the functional domain is a transcription repression domain, preferably KRAB. In some embodiments, the transcription repression domain is SID, or concatemers of SID (eg SID4X). In some embodiments, the functional domain is an epigenetic modifying domain, such that an epigenetic modifying enzyme is provided. In some embodiments, the functional domain is an activation domain, which may be the P65 activation domain.

Delivery of the Cpf1 Effector Protein Complex or Components Thereof

Through this disclosure and the knowledge in the art, CRISPR-Cas system, specifically the novel CRISPR systems described herein, or components thereof or nucleic acid molecules thereof (including, for instance HDR template) or nucleic acid molecules encoding or providing components thereof may be delivered by a delivery system herein described both generally and in detail.

Thus, gRNA (including any of the modified gRNAs as described herein elsewhere), the CRISPR enzyme (including any of the modified CRISPR enzymes as described herein elsewhere) as defined herein may each individually be comprised in a composition and administered to a host individually or collectively. Alternatively, these components may be provided in a single composition for administration to a host. Administration to a host may be performed via viral vectors known to the skilled person or described herein for delivery to a host (e.g., lentiviral vector, adenoviral vector, AAV vector). As explained herein, use of different selection markers (e.g., for lentiviral gRNA selection) and concentration of gRNA (e.g., dependent on whether multiple gRNAs are used) may be advantageous for eliciting an improved effect. On the basis of this concept, several variations are appropriate to elicit a genomic locus event, including DNA cleavage, gene activation, or gene deactivation. Using the provided compositions, the person skilled in the art can advantageously and specifically target single or multiple loci with the same or different functional domains to elicit one or more genomic locus events. The compositions may be applied in a wide variety of methods for screening in libraries in cells and functional modeling in vivo (e.g., gene activation of lincRNA and indentification of function; gain-of-function modeling; loss-of-function modeling; the use the compositions of the invention to establish cell lines and transgenic animals for optimization and screening purposes).

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a nucleic acid-targeting effector protein in combination with (and optionally complexed with) a guide RNA is delivered to a cell. Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Böhm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

Vector delivery, e.g., plasmid, viral delivery: The CRISPR enzyme, for instance a Cpf1, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Cpf1 and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1 \times 10^5$ particles (also referred to as particle units, pu) of adenoviral vector. In an embodiment herein, the dose preferably is at least about $1 \times 10^6$ particles (for example, about $1 \times 10^6$-$1 \times 10^{12}$ particles), more preferably at least about $1 \times 10^7$ particles, more preferably at least about $1 \times 10^8$ particles (e.g., about $1 \times 10^8$-$1 \times 10^{11}$ particles or about $1 \times 10^9$-$1 \times 10^{12}$ particles), and most preferably at least about $1 \times 10^0$ particles (e.g., about $1 \times 10^9$-$1 \times 10^{10}$ particles or about $1 \times 10^9$-$1 \times 10^{12}$ particles), or even at least about $1 \times 10^{10}$ particles (e.g., about $1 \times 10^{10}$-$1 \times 10^{12}$ particles) of the adenoviral vector. Alternatively, the dose comprises no more than about $1 \times 10^{14}$ particles, preferably no more than about $1 \times 10^{13}$ particles, even more preferably no more than about $1 \times 10^{12}$ particles, even more preferably no more than about $1 \times 10^{11}$ particles, and most preferably no more than about $1 \times 10^{10}$ particles (e.g., no more than about $1 \times 10^9$ articles). Thus, the dose may contain a single dose of adenoviral vector with, for example, about $1 \times 10^6$ particle units (pu), about $2 \times 10^6$ pu, about $4 \times 10^6$ pu, about $1 \times 10^7$ pu, about $2 \times 10^7$ pu, about $4 \times 10^7$ pu, about $1 \times 10^8$ pu, about $2 \times 10^8$ pu, about $4 \times 10^8$ pu, about $1 \times 10^9$ pu, about $2 \times 10^9$ pu, about $4 \times 10^9$ pu, about $1 \times 10^{10}$ pu, about $2 \times 10^{10}$ pu, about $4 \times 10^{10}$ pu, about $1 \times 10^{11}$ pu, about $2 \times 10^{11}$ pu, about $4 \times 10^{11}$ pu, about $1 \times 10^{12}$ pu, about $2 \times 10^{12}$ pu, or about $4 \times 10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1 \times 10^{10}$ to about $1 \times 10^{10}$ functional AAV/ml solution. The dosage may be adjusted to balance the therapeutic benefit against any side effects. In an embodiment herein, the AAV dose is generally in the range of concentrations of from about $1 \times 10^5$ to $1 \times 10^{50}$ genomes AAV, from about $1 \times 10^8$ to $1 \times 10^{20}$ genomes AAV, from about $1 \times 10^{10}$ to about $1 \times 10^{16}$ genomes, or about $1 \times 10^{17}$ to about $1 \times 10^{16}$ genomes AAV. A human dosage may be about $1 \times 10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 μg to about 10 μg per 70 kg individual. Plasmids of the invention will generally comprise (i) a promoter; (ii) a sequence encoding a CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Indeed, RNA delivery is a useful method of in vivo delivery. It is possible to deliver Cpf1 and gRNA (and, for instance, HR repair template) into cells using liposomes or nanoparticles. Thus delivery of the CRISPR enzyme, such as a Cpf1 and/or delivery of the RNAs of the invention may be in RNA form and via microvesicles, liposomes or particle or particles. For example, Cpf1 mRNA and gRNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via particles or particles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the CRISPR system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E (α-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free TocsiBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to α-tocopherol and co-administered with HDL targeted to the brain may be contemplated for humans in the present invention, for example, about 3 nmol to about 3 µmol of CRISPR Cas targeted to the brain may be contemplated. Zou et al. ((HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 µl of a recombinant lentivirus having a titer of $1 \times 10^9$ transducing units (TU)/ml by an intrathecal catheter. A similar dosage of CRISPR Cas expressed in a lentiviral vector targeted to the brain may be contemplated for humans in the present invention, for example, about 10-50 ml of CRISPR Cas targeted to the brain in a lentivirus having a titer of $1 \times 10^9$ transducing units (TU)/ml may be contemplated. In terms of local delivery to the brain, this can be achieved in various ways. For instance, material can be delivered intrastriatally e.g. by injection. Injection can be performed stereotactically via a craniotomy.

Enhancing NHEJ or HR efficiency is also helpful for delivery. It is preferred that NHEJ efficiency is enhanced by co-expressing end-processing enzymes such as Trex2 (Dumitrache et al. Genetics. 2011 August; 188(4): 787-797). It is preferred that HR efficiency is increased by transiently inhibiting NHEJ machineries such as Ku70 and Ku86. HR efficiency can also be increased by co-expressing prokaryotic or eukaryotic homologous recombination enzymes such as RecBCD, RecA.

Packaging and Promoters

Ways to package inventive Cpf1 coding nucleic acid molecules, e.g., DNA, into vectors, e.g., viral vectors, to mediate genome modification in vivo include:

To achieve NHEJ-mediated gene knockout:
Single virus vector:
Vector containing two or more expression cassettes:
Promoter-Cpf1 coding nucleic acid molecule-terminator
Promoter-gRNA 1-terminator
Promoter-gRNA2-terminator
Promoter-gRNA(N)-terminator (up to size limit of vector)
Double virus vector:
Vector 1 containing one expression cassette for driving the expression of Cpf1
Promoter-Cpf1 coding nucleic acid molecule-terminator
Vector 2 containing one more expression cassettes for driving the expression of one or more guideRNAs
Promoter-gRNA1-terminator
Promoter-gRNA(N)-terminator (up to size limit of vector)
To mediate homology-directed repair.

In addition to the single and double virus vector approaches described above, an additional vector can be used to deliver a homology-direct repair template.

The promoter used to drive Cpf1 coding nucleic acid molecule expression can include:
AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of Cpf1.
For ubiquitous expression, promoters that can be used include: CMV, CAG, CBh, PGK, SV40, Ferritin heavy or light chains, etc.
For brain or other CNS expression, can use promoters: SynapsinI for all neurons, CaMKIIalpha for excitatory neurons, GAD67 or GAD65 or VGAT for GABAergic neurons, etc.
For liver expression, can use Albumin promoter.
For lung expression, can use SP-B.
For endothelial cells, can use ICAM.
For hematopoietic cells can use IFNbeta or CD45.
For Osteoblasts can one can use the OG-2.
The promoter used to drive guide RNA can include:
Pol III promoters such as U6 or H1
Use of Pol II promoter and intronic cassettes to express gRNA
Adeno Associated Virus (AAV)

Cpf1 and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of Cpf1 can be driven by a cell-type specific promoter. For example, liver-specific expression might use the Albumin promoter and neuron-specific expression (e.g. for targeting CNS disorders) might use the Synapsin I promoter.

In terms of in vivo delivery, AAV is advantageous over other viral vectors for a couple of reasons:

Low toxicity (this may be due to the purification method not requiring ultra centrifugation of cell particles that can activate the immune response) and Low probability of causing insertional mutagenesis because it doesn't integrate into the host genome.

AAV has a packaging limit of 4.5 or 4.75 Kb. This means that Cpf1 as well as a promoter and transcription terminator have to be all fit into the same viral vector. Constructs larger than 4.5 or 4.75 Kb will lead to significantly reduced virus production. SpCas9 is quite large, the gene itself is over 4.1 Kb, which makes it difficult for packing into AAV. Therefore embodiments of the invention include utilizing homologs of Cpf1 that are shorter.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4 C. They were then aliquotted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine infectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the CRISPR-Cas system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the CRISPR-Cas system of the present invention.

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 μg of lentiviral transfer plasmid (pCasES10) and the following packaging plasmids: 5 μg of pMD2.G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

A minimum of 2.5×106 CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (CellGenix) at a density of 2×106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259,015.

RNA Delivery

RNA delivery: The CRISPR enzyme, for instance a Cpf1, and/or any of the present RNAs, for instance a guide RNA, can also be delivered in the form of RNA. Cpf1 mRNA can be generated using in vitro transcription. For example, Cpf1 mRNA can be synthesized using a PCR cassette containing the following elements: T7_romoter-kozak sequence (GC-CACC)-Cpf1-3' UTR from beta globin-polyA tail (a string of 120 or more adenines (SEQ ID NO: 27)). The cassette can be used for transcription by T7 polymerase. Guide RNAs can also be transcribed using in vitro transcription from a cassette containing T7_promoter-GG-guide RNA sequence.

To enhance expression and reduce possible toxicity, the CRISPR enzyme-coding sequence and/or the guide RNA can be modified to include one or more modified nucleoside e.g. using pseudo-U or 5-Methyl-C.

mRNA delivery methods are especially promising for liver delivery currently.

Much clinical work on RNA delivery has focused on RNAi or antisense, but these systems can be adapted for delivery of RNA for implementing the present invention. References below to RNAi etc. should be read accordingly.

Particle Delivery Systems and/or Formulations:

Several types of particle delivery systems and/or formulations are known to be useful in a diverse spectrum of biomedical applications. In general, a particle is defined as a small object that behaves as a whole unit with respect to its transport and properties. Particles are further classified according to diameter Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm. Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarisation interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof. Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

Particles

It will be appreciated that reference made herein to particles or nanoparticles can be interchangeable, where appropriate. CRISPR enzyme mRNA and guide RNA may be delivered simultaneously using particles or lipid envelopes; for instance, CRISPR enzyme and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes).

Nucleic acid-targeting effector proteins (such as a Type V protein such Cpf1) mRNA and guide RNA may be delivered simultaneously using particles or lipid envelopes.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured nanoparticles with a poly(β-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles/nanoparticles based on self assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al. Biomacromolecules, 2006. 7(12):3452-9 and Uchegbu, I. F., et al. Int J Pharm, 2001. 224:185-199). Doses of about 5 mg/kg are contemplated, with single or multiple doses, depending on the target tissue.

In one embodiment, particles/nanoparticles that can deliver RNA to a cancer cell to stop tumor growth developed by Dan Anderson's lab at MIT may be used/and or adapted to the CRISPR Cas system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds are also particularly useful in the administration of polynucleotides, which may be applied to deliver the CRISPR Cas system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The minoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated. US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the CRISPR Cas system of the present invention. In some embodiments, sugar-based particles may be used, for example GalNAc, as described herein and with reference to WO2014118272 (incorporated herein by reference) and Nair, J K et al., 2014, Journal of the American Chemical Society 136 (49), 16958-16961) and the teaching herein, especially in respect of delivery applies to all particles unless otherwise apparent.

In another embodiment, lipid nanoparticles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the CRISPR Cas system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabemero et al., Cancer Discovery, April 2013, Vol. 3, No. 4, pages 363-470) and are therefore contemplated for delivering RNA encoding CRISPR Cas to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, December 2011). A dosage of 1 µg/ml of LNP or CRISPR-Cas RNA in or associated with the LNP may be contemplated, especially for a formulation containing DLinKC2-DMA.

Preparation of LNPs and CRISPR Cas encapsulation may be used/and or adapted from Rosin et al, Molecular Therapy, vol. 19, no. 12, pages 1286-2200, December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(co-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, MO). The specific CRISPR Cas RNA may be encapsulated in LNPs containing DLinDAP, DLinDMA, DLinK-DMA, and DLinKC2-DMA (cationic lipid:DSPC: CHOL:PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/l. This ethanol solution of lipid may be added drop-wise to 50 mmol/1 citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Nanoparticle size distribution may be determined by dynamic light scattering using a NICOMP 370 particle sizer, the vesicle/intensity modes, and Gaussian fitting (Nicomp Particle Sizing, Santa Barbara, CA). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted nanoparticles and quantified at 260 nm. RNA to lipid ratio was determined by measurement of cholesterol content in vesicles using the Cholesterol E enzymatic assay from Wako Chemicals USA (Richmond, VA). In conjunction with the herein discussion of LNPs and PEG lipids, PEGylated liposomes or LNPs are likewise suitable for delivery of a CRISPR-Cas system or components thereof.

Preparation of large LNPs may be used/and or adapted from Rosin et al, Molecular Therapy, vol. 19, no. 12, pages 1286-2200, December 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate: DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at an RNA to total lipid ratio of approximately 1:10 (wt:wt), followed by incubation for 30 minutes at 37° C. to form loaded LNPs. The mixture may be subsequently dialyzed overnight in PBS and filtered with a 0.45-µm syringe filter.

Spherical Nucleic Acid (SNA™) constructs and other nanoparticles (particularly gold nanoparticles) are also contemplated as a means to delivery CRISPR-Cas system to intended targets. Significant data show that AuraSense Therapeutics' Spherical Nucleic Acid (SNA™) constructs, based upon nucleic acid-functionalized gold nanoparticles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling nanoparticles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of CRISPR Cas is envisioned for delivery in the self-assembling nanoparticles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclododecane-1,4,7,10-tetraacetic acid mono(N-hydroxysuccinimide ester) (DOTA-NHSester) was ordered from Macrocyclics (Dallas, TX). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, CA) to remove trace metal contaminants. Tf-targeted and nontargeted siRNA nanoparticles may be formed by using cyclodextrin-containing polycations. Typically, nanoparticles were formed in water at a charge ratio of 3 (+/−) and an siRNA concentration of 0.5 g/liter. One percent of the adamantane-PEG molecules on the surface of the targeted nanoparticles were modified with Tf (adamantane-PEG-Tf). The nanoparticles were suspended in a 5% (wt/vol) glucose carrier solution for injection.

Davis et al. (Nature, Vol 464, 15 Apr. 2010) conducts a RNA clinical trial that uses a targeted nanoparticle-delivery system (clinical trial registration number NCT00689065). Patients with solid cancers refractory to standard-of-care therapies are administered doses of targeted nanoparticles on days 1, 3, 8 and 10 of a 21-day cycle by a 30-min intravenous infusion. The nanoparticles consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+ 5). The TFR has long been known to be upregulated in malignant cells, and RRM2 is an established anti-cancer target. These nanoparticles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg $m^{-2}$ siRNA, respectively. Similar doses may also be contemplated for the CRISPR Cas system of the present invention. The delivery of the invention may be achieved with nanoparticles containing a linear, cyclodextrin-based polymer (CDP), a human transferrin protein (TF) targeting ligand displayed on the exterior of the nanoparticle to engage TF receptors (TFR) on the surface of the cancer cells and/or a hydrophilic polymer (for example, polyethylene glycol (PEG) used to promote nanoparticle stability in biological fluids).

In terms of this invention, it is preferred to have one or more components of CRISPR complex, e.g., CRISPR enzyme or mRNA or guide RNA delivered using nanoparticles or lipid envelopes. Other delivery systems or vectors are may be used in conjunction with the nanoparticle aspects of the invention.

In general, a "nanoparticle" refers to any particle having a diameter of less than 1000 nm. In certain preferred embodiments, nanoparticles of the invention have a greatest dimension (e.g., diameter) of 500 nm or less. In other preferred embodiments, nanoparticles of the invention have a greatest dimension ranging between 25 nm and 200 nm. In other preferred embodiments, nanoparticles of the invention have a greatest dimension of 100 nm or less. In other preferred embodiments, nanoparticles of the invention have a greatest dimension ranging between 35 nm and 60 nm.

Nanoarticles encompassed in the present invention may be provided in different forms, e.g., as solid nanoparticles (e.g., metal such as silver, gold, iron, titanium), non-metal, lipid-based solids, polymers), suspensions of nanoparticles, or combinations thereof. Metal, dielectric, and semiconductor nanoparticles may be prepared, as well as hybrid structures (e.g., core-shell nanoparticles). Nanoparticles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft nanoparticles have been manufactured, and are within the scope of the present invention. A prototype nanoparticle of semi-solid nature is the liposome. Various types of liposome nanoparticles are currently used clinically as delivery systems for anticancer drugs and vaccines. Nanoparticles with one half hydrophilic and the other half hydrophobic are termed Janus particles and are particularly effective for stabilizing emulsions. They can self-assemble at water/oil interfaces and act as solid surfactants.

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid.

U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material.

U.S. Pat. No. 5,855,913, incorporated herein by reference, provides a particulate composition having aerodynamically light particles having a tap density of less than 0.4 g/cm3 with a mean diameter of between 5 µm and 30 µm, incorporating a surfactant on the surface thereof for drug delivery to the pulmonary system.

U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system.

U.S. Pat. No. 5,543,158, incorporated herein by reference, provides biodegradable injectable particles having a biodegradable solid core containing a biologically active material and poly(alkylene glycol) moieties on the surface.

WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can envisioned that such conjugated lipomers can be used in the context of the CRISPR-Cas system to achieve in vitro, ex vivo and in vivo genomic perturbations to modify gene expression, including modulation of protein expression.

In one embodiment, the nanoparticle may be epoxide-modified lipid-polymer, advantageously 7C1 (see, e.g., James E. Dahlman and Carmen Barnes et al. Nature Nanotechnology (2014) published online 11 May 2014, doi: 10.1038/nnano.2014.84). C71 was synthesized by reacting C15 epoxide-terminated lipids with PEI600 at a 14:1 molar ratio, and was formulated with C14PEG2000 to produce nanoparticles (diameter between 35 and 60 nm) that were stable in PBS solution for at least 40 days.

An epoxide-modified lipid-polymer may be utilized to deliver the CRISPR-Cas system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by nanoparticle tracking analysis (NTA) and electron microscopy. Alvarez-Erviti et al. obtained 6-12 µg of exosomes (measured based on protein concentration) per $10^6$ cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 µF resulted in the greatest retention of RNA and was used for all subsequent experiments.

Alvarez-Erviti et al. administered 150 µg of each BACE1 siRNA encapsulated in 150 µg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, P<0.05, versus 62%, P<0.01) in both siRNA-RVG-9R-treated and siRNARVG exosome-treated mice was observed, resulting from a significant decrease in BACE1 mRNA levels (66% [+ or −] 15%, P<0.001 and 61% [+ or −] 13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the β-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the CRISPR-Cas system of the present invention to therapeutic targets, especially neurodegenerative diseases. A dosage of about 100 to 1000 mg of CRISPR Cas encapsulated in about 100 to 1000 mg of RVG exosomes may be contemplated for the present invention.

El-Andaloussi et al. (Nature Protocols 7, 2112-2126 (2012)) discloses how exosomes derived from cultured cells can be harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention. In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention.

Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of CRISPR Cas into exosomes may be conducted similarly to siRNA. The exosomes may be co-cultured with monocytes and lymphocytes isolated from the peripheral blood of healthy donors. Therefore, it may be contemplated that exosomes containing CRISPR Cas may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review).

A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review).

In a particularly advantageous embodiment, Trojan Horse liposomes (also known as Molecular Trojan Horses) are desirable and protocols may be found at cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR family of nucleases to the brain via an intravascular injection, which would allow whole brain transgenic animals without the need for embryonic manipulation. About 1-5 g of DNA or RNA may be contemplated for in vivo administration in liposomes.

In another embodiment, the CRISPR Cas system or components thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific CRISPR Cas targeted in a SNALP are contemplated. The daily treatment may be over about three days and then weekly for about five weeks. In another embodiment, a specific CRISPR Cas encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(wmethoxypoly (ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, MO, USA), dipalmitoylphosphatidylcholine (Avanti Polar Lipids, Alabaster, AL, USA), 3-N-[(w-methoxy poly(ethylene glycol) 2000)carbamoyl]-1,2-dimyrestyloxypropylamine, and cationic 1,2-dilinoleyloxy-3-N,Ndimethylaminopropane (see, e.g., Geisbert et al., Lancet 2010; 375: 1896-905). A dosage of about 2 mg/kg total CRISPR Cas per dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N; N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids—an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial. Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC)—both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Niotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM $Na_2HPO_4$, 1 mM $KH_2PO_4$, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 μm filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the CRISPR Cas system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate CRISPR Cas or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11±0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the CRISPR Cas system of the present invention or component(s) thereof or nucleic acid molecule(s) coding therefor to form lipid nanoparticles (LNPs). Lipids include, but are not limited to, DLin-KC2-DMA4, C12-200 and colipids disteroylphosphatidyl choline, cholesterol, and PEG-DMG may be formulated with CRISPR Cas instead of siRNA (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid:siRNA weight ratio may be ~12:1 and 9:1 in the case of DLin-KC2-DMA and C12-200 lipid nanoparticles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The CRISPR Cas system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesised from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N—P(O$_2$)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied.

US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of CRISPR Cas system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of CRISPR Cas system(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified +36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116) (However, pilot experiments varying the dose of protein and RNA should be performed to optimize the procedure for specific cell lines):

(1) One day before treatment, plate 1×10$^5$ cells per well in a 48-well plate.
(2) On the day of treatment, dilute purified+36 GFP protein in serumfree media to a final concentration 200 nM. Add RNA to a final concentration of 50 nM. Vortex to mix and incubate at room temperature for 10 min.
(3) During incubation, aspirate media from cells and wash once with PBS.
(4) Following incubation of +36 GFP and RNA, add the protein-RNA complexes to cells.
(5) Incubate cells with complexes at 37° C. for 4h.
(6) Following incubation, aspirate the media and wash three times with 20 U/mL heparin PBS. Incubate cells with serum-containing media for a further 48h or longer depending upon the assay for activity.
(7) Analyze cells by immunoblot, qPCR, phenotypic assay, or other appropriate method.

David Liu's lab has further found +36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications:

(1) One day before treatment, plate 1×10$^5$ per well in a 48-well plate. (2) On the d
ay of treatment, dilute purified p36 GFP protein in serumfree media to a final concentration 2 mM. Add 1 mg of plasmid DNA. Vortex to mix and incubate at room temperature for 10 min.
(3) During incubation, aspirate media from cells and wash once with PBS.
(4) Following incubation of 36 GFP and plasmid DNA, gently add the protein-DNA complexes to cells.
(5) Incubate cells with complexes at 37 C for 4h.
(6) Following incubation, aspirate the media and wash with PBS. Incubate cells in serum-containing media and incubate for a further 24-48h.
(7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the CRISPR Cas system of the present invention. These systems of Dr. Lui and documents herein in conjunction with herein teaching can be employed in the delivery of CRISPR Cas system(s) or component(s) thereof or nucleic acid molecule(s) coding therefor.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles, including nanoparticles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intrarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R)4 (Ahx=aminohexanoyl) (SEQ ID NO: 28).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Implantable Devices

In another embodiment, implantable devices are also contemplated for delivery of the CRISPR Cas system or component(s) thereof or nucleic acid molecule(s) coding therefor. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. An implantable delivery device can be advantageous in providing release locally and over a prolonged period, where drug is released directly to the extracellular matrix (ECM) of the diseased area such as tumor, inflammation, degeneration or for symptomatic objectives, or to injured smooth muscle cells, or for prevention. One kind of drug is RNA, as disclosed above, and this system may be used/and or adapted to the CRISPR Cas system of the present invention. The modes of implantation in some embodiments are existing implantation procedures that are developed and used today for other treatments, including brachytherapy and needle biopsy. In such cases the dimensions of the new implant described in this invention are similar to the original implant. Typically a few devices are implanted during the same treatment procedure.

US Patent Publication 20110195123, provides a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123.

The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 m$^3$ to 1000 mm$^3$, as required by the volume for the agent load. The Loder may optionally be larger, for example when incorporated with a device whose size is determined by functionality, for example and without limitation, a knee joint, an intra-uterine or cervical ring and the like.

The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or may fluctuate, for example increasing and decreasing to a certain degree. The diffusion rate is preferably so maintained for a prolonged period, and it can be considered constant to a certain level to optimize the therapeutically effective period, for example the effective silencing period.

The drug delivery system optionally and preferably is designed to shield the nucleotide based therapeutic agent from degradation, whether chemical in nature or due to attack from enzymes and other factors in the body of the subject.

The drug delivery system of US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices.

According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle.

The site for implantation of the composition, or target site, preferably features a radius, area and/or volume that is sufficiently small for targeted local delivery. For example, the target site optionally has a diameter in a range of from about 0.1 mm to about 5 cm.

The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof.

For example the composition (optionally with the device) is optionally implanted within or in the proximity to pancreas, prostate, breast, liver, via the nipple, within the vascular system and so forth.

The target location is optionally selected from the group comprising, consisting essentially of, or consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear-auditory system, labyrinth of the inner ear, vestibular system; 11. Intra tracheal; 12. Intracardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal.

Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site.

Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators.

According to other embodiments of US Patent Publication 20110195123, the drug preferably comprises a RNA, for example for localized cancer cases in breast, pancreas, brain, kidney, bladder, lung, and prostate as described below. Although exemplified with RNAi, many drugs are applicable to be encapsulated in Loder, and can be used in association with this invention, as long as such drugs can be encapsulated with the Loder substrate, such as a matrix for example, and this system may be used and/or adapted to deliver the CRISPR Cas system of the present invention.

As another example of a specific application, neuro and muscular degenerative diseases develop due to abnormal gene expression. Local delivery of RNAs may have therapeutic properties for interfering with such abnormal gene expression. Local delivery of anti apoptotic, anti inflammatory and anti degenerative drugs including small drugs and macromolecules may also optionally be therapeutic. In such cases the Loder is applied for prolonged release at constant rate and/or through a dedicated device that is implanted separately. All of this may be used and/or adapted to the CRISPR Cas system of the present invention.

As yet another example of a specific application, psychiatric and cognitive disorders are treated with gene modifiers. Gene knockdown is a treatment option. Loders locally delivering agents to central nervous system sites are therapeutic options for psychiatric and cognitive disorders including but not limited to psychosis, bi-polar diseases, neurotic disorders and behavioral maladies. The Loders could also deliver locally drugs including small drugs and macromolecules upon implantation at specific brain sites. All of this may be used and/or adapted to the CRISPR Cas system of the present invention.

As another example of a specific application, silencing of innate and/or adaptive immune mediators at local sites enables the prevention of organ transplant rejection. Local delivery of RNAs and immunomodulating reagents with the Loder implanted into the transplanted organ and/or the implanted site renders local immune suppression by repelling immune cells such as CD8 activated against the transplanted organ. All of this may be used/and or adapted to the CRISPR Cas system of the present invention.

As another example of a specific application, vascular growth factors including VEGFs and angiogenin and others are essential for neovascularization. Local delivery of the factors, peptides, peptidomimetics, or suppressing their repressors is an important therapeutic modality; silencing the repressors and local delivery of the factors, peptides, macromolecules and small drugs stimulating angiogenesis with the Loder is therapeutic for peripheral, systemic and cardiac vascular disease.

The method of insertion, such as implantation, may optionally already be used for other types of tissue implantation and/or for insertions and/or for sampling tissues, optionally without modifications, or alternatively optionally only with non-major modifications in such methods. Such methods optionally include but are not limited to brachytherapy methods, biopsy, endoscopy with and/or without ultrasound, such as ERCP, stereotactic methods into the brain tissue, Laparoscopy, including implantation with a laparoscope into joints, abdominal organs, the bladder wall and body cavities.

Implantable device technology herein discussed can be employed with herein teachings and hence by this disclosure and the knowledge in the art, CRISPR-Cas system or components thereof or nucleic acid molecules thereof or encoding or providing components may be delivered via an implantable device.

Patient-Specific Screening Methods

A nucleic acid-targeting system that targets DNA, e.g., trinucleotide repeats can be used to screen patients or patent samples for the presence of such repeats. The repeats can be the target of the RNA of the nucleic acid-targeting system, and if there is binding thereto by the nucleic acid-targeting system, that binding can be detected, to thereby indicate that such a repeat is present. Thus, a nucleic acid-targeting system can be used to screen patients or patient samples for the presence of the repeat. The patient can then be administered suitable compound(s) to address the condition; or, can be administered a nucleic acid-targeting system to bind to and cause insertion, deletion or mutation and alleviate the condition.

The invention uses nucleic acids to bind target DNA sequences.

CRISPR Effector Protein mRNA and Guide RNA

CRISPR enzyme mRNA and guide RNA might also be delivered separately. CRISPR enzyme mRNA can be delivered prior to the guide RNA to give time for CRISPR enzyme to be expressed. CRISPR enzyme mRNA might be administered 1-12 hours (preferably around 2-6 hours) prior to the administration of guide RNA.

Alternatively, CRISPR enzyme mRNA and guide RNA can be administered together. Advantageously, a second booster dose of guide RNA can be administered 1-12 hours (preferably around 2-6 hours) after the initial administration of CRISPR enzyme mRNA+guide RNA.

The CRISPR effector protein of the present invention, i.e. Cpf1 effector protein is sometimes referred to herein as a CRISPR Enzyme. It will be appreciated that the effector protein is based on or derived from an enzyme, so the term 'effector protein' certainly includes 'enzyme' in some embodiments. However, it will also be appreciated that the effector protein may, as required in some embodiments, have DNA binding, but not necessarily cutting or nicking, activity, including a dead-Cas effector protein function.

Additional administrations of CRISPR enzyme mRNA and/or guide RNA might be useful to achieve the most efficient levels of genome modification. In some embodiments, phenotypic alteration is preferably the result of genome modification when a genetic disease is targeted, especially in methods of therapy and preferably where a repair template is provided to correct or alter the phenotype.

In some embodiments diseases that may be targeted include those concerned with disease-causing splice defects.

In some embodiments, cellular targets include Hemopoietic Stem/Progenitor Cells (CD34+); Human T cells; and Eye (retinal cells)—for example photoreceptor precursor cells.

In some embodiments Gene targets include: Human Beta Globin—HBB (for treating Sickle Cell Anemia, including by stimulating gene-conversion (using closely related HBD gene as an endogenous template)); CD3 (T-Cells); and CEP920—retina (eye).

In some embodiments disease targets also include: cancer; Sickle Cell Anemia (based on a point mutation); HIV; Beta-Thalassemia; and ophthalmic or ocular disease—for example Leber Congenital Amaurosis (LCA)-causing Splice Defect.

In some embodiments delivery methods include: Cationic Lipid Mediated "direct" delivery of Enzyme-Guide complex (RiboNucleoProtein) and electroporation of plasmid DNA.

Inventive methods can further comprise delivery of templates, such as repair templates, which may be dsODN or ssODN, see below. Delivery of templates may be via the cotemporaneous or separate from delivery of any or all the CRISPR enzyme or guide and via the same delivery mechanism or different. In some embodiments, it is preferred that the template is delivered together with the guide, and, preferably, also the CRISPR enzyme. An example may be an AAV vector.

Inventive methods can further comprise: (a) delivering to the cell a double-stranded oligodeoxynucleotide (dsODN) comprising overhangs complimentary to the overhangs created by said double strand break, wherein said dsODN is integrated into the locus of interest; or—b) delivering to the cell a single-stranded oligodeoxynucleotide (ssODN), wherein said ssODN acts as a template for homology directed repair of said double strand break. Inventive methods can be for the prevention or treatment of disease in an individual, optionally wherein said disease is caused by a defect in said locus of interest. Inventive methods can be conducted in vivo in the individual or ex vivo on a cell taken from the individual, optionally wherein said cell is returned to the individual.

For minimization of toxicity and off-target effect, it will be important to control the concentration of CRISPR enzyme mRNA and guide RNA delivered. Optimal concentrations of CRISPR enzyme mRNA and guide RNA can be determined by testing different concentrations in a cellular or animal model and using deep sequencing the analyze the extent of modification at potential off-target genomic loci. For example, for the guide sequence targeting 5'-GAGTCCGAGCAGAAGAAGAA-3' (SEQ ID NO: 23)

in the EMX1 gene of the human genome, deep sequencing can be used to assess the level of modification at the following two off-target loci, 1: 5'-GAGTCCTAGCAG-GAGAAGAA-3' (SEQ ID NO: 24) and 2: 5'-GAGTCTAAGCAGAAGAAGAA-3' (SEQ ID NO: 25). The concentration that gives the highest level of on-target modification while minimizing the level of off-target modification should be chosen for in vivo delivery.

Inducible Systems

In some embodiments, a CRISPR enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736, 465 and U.S. 61/721,283, and WO 2014/018423 A2 and U.S. Pat. Nos. 8,889,418, 8,895,308, US20140186919, US20140242700, US20140273234, US20140335620, WO2014093635 which is hereby incorporated by reference in its entirety.

The current invention comprehends the use of the compositions of the current invention to establish and utilize conditional or inducible CRISPR transgenic cell/animals; see, e.g., Platt et al., Cell (2014), 159(2): 440-455, or PCT patent publications cited herein, such as WO 2014/093622 (PCT/US2013/074667). For example, cells or animals such as non-human animals, e.g., vertebrates or mammals, such as rodents, e.g., mice, rats, or other laboratory or field animals, e.g., cats, dogs, sheep, etc., may be 'knock-in' whereby the animal conditionally or inducibly expresses Cpf1 (including any of the modified Cpf1s as described herein) akin to Platt et al. The target cell or animal thus comprises CRISRP enzyme (e.g., Cpf1) conditionally or inducibly (e.g., in the form of Cre dependent constructs) and/or an adapter protein conditionally or inducibly and, on expression of a vector introduced into the target cell, the vector expresses that which induces or gives rise to the condition of CRISPR enzyme (e.g., Cpf1) expression and/or adaptor expression in the target cell. By applying the teaching and compositions of the current invention with the known method of creating a CRISPR complex, inducible genomic events are also an aspect of the current invention. One mere example of this is the creation of a CRISPR knock-in/conditional transgenic animal (e.g., mouse comprising e.g., a Lox-Stop-polyA-Lox (LSL) cassette) and subsequent delivery of one or more compositions providing one or more (modified) gRNA (e.g., –200 nucleotides to TSS of a target gene of interest for gene activation purposes, e.g., modified gRNA with one or more aptamers recognized by coat proteins, e.g., MS2), one or more adapter proteins as described herein (MS2 binding protein linked to one or more VP64) and means for inducing the conditional animal (e.g., Cre recombinase for rendering Cpf1 expression inducible). Alternatively, an adaptor protein may be provided as a conditional or inducible element with a conditional or inducible CRISPR enzyme to provide an effective model for screening purposes, which advantageously only requires minimal design and administration of specific gRNAs for a broad number of applications.

Enzymes According to the Invention Having or Associated with Destabilization Domains In one aspect, the invention provides a non-naturally occurring or engineered CRISPR enzyme, preferably a class 2 CRISPR enzyme, preferably a Type V or VI CRISPR enzyme as described herein, such as preferably but without limitation Cpf1 as described herein elsewhere, associated with at least one destabilization domain (DD); and, for shorthand purposes, such a non-naturally occurring or engineered CRISPR enzyme associated with at least one destabilization domain (DD) is herein termed a "DD-CRISPR enzyme". It is to be understood that any of the CRISPR enzymes according to the invention as described herein elsewhere may be used as having or being associated with destabilizing domains as described herein below. Any of the methods, products, compositions and uses as described herein elsewhere are equally applicable with the CRISPR enzymes associated with destabilizing domains as further detailed below. It is to be understood, that in the aspects and embodiments as described herein, when referring to or reading on Cpf1 as the CRISPR enzyme, reconstitution of a functional CRISPR-Cas system preferably does not require or is not dependent on a tracr sequence and/or direct repeat is 5' (upstream) of the guide (target or spacer) sequence.

By means of further guidance, the following particular aspects and embodiments are provided. As the aspects and embodiments as described in this section involve DD-CRISPR enzymes, DD-Cas, DD-Cpf1, DD-CRISPR-Cas or DD-CRISPR-Cpf1 systems or complexes, the terms "CRISPR", "Cas", "Cpf1, "CRISPR system", "CRISPR complex", "CRISPR-Cas", "CRISPR-Cpf1" or the like, without the prefix "DD" may be considered as having the prefix DD, especially when the context permits so that the disclosure is reading on DD embodiments. In one aspect, the invention provides an engineered, non-naturally occurring DD-CRISPR-Cas system comprising a DD-CRISPR enzyme, e.g, such a DD-CRISPR enzyme wherein the CRISPR enzyme is a Cas protein (herein termed a "DD-Cas protein", i.e., "DD" before a term such as "DD-CRISPR-Cpf1 complex" means a CRISPR-Cpf1 complex having a Cpf1 protein having at least one destabilization domain associated therewith), advantageously a DD-Cas protein, e.g., a Cpf1 protein associated with at least one destabilization domain (herein termed a "DD-Cpf1 protein") and guide RNA that targets a nucleic acid molecule such as a DNA molecule, whereby the guide RNA targets the nucleic acid molecule, e.g., DNA molecule. The nucleic acid molecule, e.g., DNA molecule can encode a gene product. In some embodiments the DD-Cas protein may cleave the DNA molecule encoding the gene product. In some embodiments expression of the gene product is altered. The Cas protein and the guide RNA do not naturally occur together. In some embodiments, the functional CRISPR-Cas system may comprise further functional domains. In some embodiments, the invention provides a method for altering or modifying expression of a gene product. The method may comprise introducing into a cell containing a target nucleic acid, e.g., DNA molecule, or containing and expressing a target nucleic acid, e.g., DNA molecule; for instance, the target nucleic acid may encode a gene product or provide for expression of a gene product (e.g., a regulatory sequence).

In some embodiments, the DD-CRISPR enzyme is a DD-Cpf1. In some embodiments, the DD-CRISPR enzyme is a subtype V-A or V-B CRISPR enzyme. In some embodiments, the DD-CRISPR enzyme is Cpf1. In some embodiments, the DD-CRISPR enzyme is an As DD-Cpf1. In some embodiments, the CRISPR enzyme is an Lb DD-Cpf1. In some embodiments, the DD-CRISPR enzyme cleave both strands of DNA to produce a double strand break (DSB). In some embodiments, the DD-CRISPR enzyme is a nickase. In some embodiments, the DD-CRISPR enzyme is a dual nickase. In some embodiments, the DD-CRISPR enzyme is a deadCpf1, e.g., a Cpf1 having substantially no nuclease activity, e.g., no more than 5% nuclease activity as compared with a wild-type Cpf1 or Cpf1 not having had mutations to it. Suitable Cpf1 mutations are described herein elsewhere, and include for instance D917A, E1006A, E1028A, D1227A, D1255A, N1257A, D917A, E1006A, E1028A, D1227A, D1255A and N1257A with reference to the amino acid positions in the FnCpf1p RuvC domain; or for instance N580A, N584A, T587A, W609A, D610A, K613A, E614A, D616A, K624A, D625A, K627A and Y629A with reference to the putative second nuclease domain as described herein elsewhere.

In some general embodiments, the DD-CRISPR enzyme is associated with one or more functional domains. In some more specific embodiments, the DD-CRISPR enzyme is a deadCpf1 and/or is associated with one or more functional domains. In some embodiments, the DD-CRISPR enzyme comprises a truncation of for instance the α-helical or mixed α/β secondary structure. In some embodiments, the truncation comprises removal or replacement with a linker. In some embodiments, the linker is branched or otherwise allows for tethering of the DD and/or a functional domain. In some embodiments, the CRISPR enzyme is associated with the DD by way of a fusion protein. In some embodiments, the CRISPR enzyme is fused to the DD. In other words, the DD may be associated with the CRISPR enzyme by fusion with said CRISPR enzyme. In some embodiments, the enzyme may be considered to be a modified CRISPR enzyme, wherein the CRISPR enzyme is fused to at least one destabilization domain (DD). In some embodiments, the DD may be associated to the CRISPR enzyme via a connector protein, for example using a system such as a marker system such as the streptavidin-biotin system. As such, provided is a fusion of a CRISPR enzyme with a connector protein specific for a high affinity ligand for that connector, whereas the DD is bound to said high affinity ligand. For example, strepavidin may be the connector fused to the CRISPR enzyme, while biotin may be bound to the DD. Upon co-localization, the streptavidin will bind to the biotin, thus connecting the CRISPR enzyme to the DD. For simplicity, a fusion of the CRISPR enzyme and the DD is preferred in some embodiments. In some embodiments, the fusion comprises a linker between the DD and the CRISPR enzyme. In some embodiments, the fusion may be to the N-terminal end of the CRISPR enzyme. In some embodiments, at least one DD is fused to the N-terminus of the CRISPR enzyme. In some embodiments, the fusion may be to the C-terminal end of the CRISPR enzyme. In some embodiments, at least one DD is fused to the C-terminus of the CRISPR enzyme. In some embodiments, one DD may be fused to the N-terminal end of the CRISPR enzyme with another DD fused to the C-terminal of the CRISPR enzyme. In some embodiments, the CRISPR enzyme is associated with at least two DDs and wherein a first DD is fused to the N-terminus of the CRISPR enzyme and a second DD is fused to the C-terminus of the CRISPR enzyme, the first and second DDs being the same or different. In some embodiments, the fusion may be to the N-terminal end of the DD. In some embodiments, the fusion may be to the C-terminal end of the DD. In some embodiments, the fusion may between the C-terminal end of the CRISPR enzyme and the N-terminal end of the DD. In some embodiments, the fusion may between the C-terminal end of the DD and N-terminal end of the CRISPR enzyme. Less background was observed with a DD comprising at least one N-terminal fusion than a DD comprising at least one C terminal fusion. Combining N- and C-terminal fusions had the least background but lowest overall activity. Advantageously a DD is provided through at least one N-terminal fusion or at least one N terminal fusion plus at least one C-terminal fusion. And of course, a DD can be provided by at least one C-terminal fusion.

In certain embodiments, protein destabilizing domains, such as for inducible regulation, can be fused to the N-term and/or the C-term of e.g. Cpf1. Additionally, destabilizing domains can be introduced into the primary sequence of e.g. Cpf1 at solvent exposed loops. Computational analysis of the primary structure of Cpf1 nucleases reveals three distinct regions. First a C-terminal RuvC like domain, which is the only functional characterized domain. Second a N-terminal alpha-helical region and thirst a mixed alpha and beta region, located between the RuvC like domain and the alpha-helical region. Several small stretches of unstructured regions are predicted within the Cpf1 primary structure. Unstructured regions, which are exposed to the solvent and not conserved within different Cpf1 orthologues, are preferred sides for splits and insertions of small protein sequences. In addition, these sides can be used to generate chimeric proteins between Cpf1 orthologs.

In some embodiments, the DD is ER50. A corresponding stabilizing ligand for this DD is, in some embodiments, 4HT. As such, in some embodiments, one of the at least one DDs is ER50 and a stabilizing ligand therefor is 4HT. or CMP8 In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the CRISPR enzyme with one or two DDs fused to the C-terminal of the CRISPR enzyme. In some embodiments, the at least two DDs are associated with the CRISPR enzyme and the DDs are the same DD, i.e. the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the CRISPR enzyme and the DDs are different DDs, i.e. the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N or C-term may enhance degradation; and such a tandem fusion can be, for example ER50-ER50-Cpf1 or DHFR-DHFR-Cpf1 It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the CRISPR enzyme with the DD comprises a linker between the DD and the CRISPR enzyme. In some embodiments, the linker is a GlySer linker. In some embodiments, the DD-CRISPR enzyme further comprises at least one Nuclear Export Signal (NES). In some embodiments, the DD-CRISPR enzyme comprises two or more NESs. In some embodiments, the DD-CRISPR enzyme comprises at least one Nuclear Localization Signal (NLS). This may be in addition to an NES. In some embodiments, the CRISPR enzyme comprises or consists essentially of or consists of a localization (nuclear import or export) signal as, or as part of, the linker between the CRISPR enzyme and the DD. HA or Flag tags are also within the ambit of the invention as linkers. Applicants use NLS and/or NES as linker and also use Glycine Serine linkers as short as GS up to (GGGGS)$_3$ (SEQ ID NO: 19).

In an aspect, the present invention provides a polynucleotide encoding the CRISPR enzyme and associated DD. In some embodiments, the encoded CRISPR enzyme and associated DD are operably linked to a first regulatory element. In some embodiments, a DD is also encoded and is operably linked to a second regulatory element. Advantageously, the DD here is to "mop up" the stabilizing ligand and so it is advantageously the same DD (i.e. the same type of Domain) as that associated with the enzyme, e.g., as herein discussed (with it understood that the term "mop up" is meant as discussed herein and may also convey performing so as to contribute or conclude activity). By mopping up the stabilizing ligand with excess DD that is not associated with the CRISPR enzyme, greater degradation of the CRISPR enzyme will be seen. It is envisaged, without being bound by theory, that as additional or excess un-associated DD is added that the equilibrium will shift away from the stabilizing ligand complexing or binding to the DD associated with the CRISPR enzyme and instead move towards more of the stabilizing ligand complexing or binding to the free DD (i.e. that not associated with the CRISPR enzyme). Thus, provision of excess or additional unassociated (o free) DD is preferred when it is desired to reduce CRISPR enzyme activity though increased degradation of the CRISPR enzyme. An excess of free DD with bind residual ligand and also takes away bound ligand from DD-Cas fusion. Therefore it accelerates DD-Cas degradation and enhances temporal control of Cas activity. In some embodiments, the first regulatory element is a promoter and may optionally include an enhancer. In some embodiments, the second regulatory element is a promoter and may optionally include an enhancer. In some embodiments, the first regulatory element is an early promoter. In some embodiments, the second regulatory element is a late promoter. In some embodiments, the second regulatory element is or comprises or consists essentially of an inducible control element, optionally the tet system, or a repressible control element, optionally the tetr system. An inducible promoter may be favorable e.g. rTTA to induce tet in the presence of doxycycline.

Attachment or association can be via a linker, e.g., a flexible glycine-serine (GlyGlyGlySer) (SEQ ID NO: 18) or (GGGS)$_3$ (SEQ ID NO: 797) or a rigid alpha-helical linker such as (Ala(GluAlaAlaAlaLys)Ala) (SEQ ID NO: 798). Linkers such as (GGGGS)$_3$ (SEQ ID NO: 19) are preferably used herein to separate protein or peptide domains. (GGGGS)$_3$ (SEQ ID NO: 19) is preferable because it is a relatively long linker (15 amino acids). The glycine residues are the most flexible and the serine residues enhance the chance that the linker is on the outside of the protein. (GGGGS)$_6$ (SEQ ID NO: 20) (GGGGS)$_9$ (SEQ ID NO: 21) or (GGGGS)$_{12}$ (SEQ ID NO: 22) may preferably be used as alternatives. Other preferred alternatives are (GGGGS)$_1$ (SEQ ID NO: 789), (GGGGS)$_2$ (SEQ ID NO: 790), (GGGGS)$_4$ (SEQ ID NO: 791), (GGGGS)$_5$ (SEQ ID NO: 792), (GGGGS)$_7$ (SEQ ID NO: 793), (GGGGS)$_8$ (SEQ ID NO: 794), (GGGGS)$_{10}$ (SEQ ID NO: 795), or (GGGGS)$_{11}$ (SEQ ID NO: 796). Alternative linkers are available, but highly flexible linkers are thought to work best to allow for maximum opportunity for the 2 parts of the Cas to come together and thus reconstitute Cas activity. One alternative is that the NLS of nucleoplasmin can be used as a linker. For example, a linker can also be used between the Cas and any functional domain. Again, a (GGGGS)$_3$ (SEQ ID NO: 19) linker may be used here (or the 6 (SEQ ID NO: 20), 9 (SEQ ID NO: 21), or 12 (SEQ ID NO: 22) repeat versions therefore) or the NLS of nucleoplasmin can be used as a linker between Cas and the functional domain.

Also provided is a method of treating a subject, e.g., a subject in need thereof, comprising inducing gene editing by transforming the subject with the polynucleotide encoding the system or any of the present vectors and administering stabilizing ligand to the subject. A suitable repair template may also be provided, for example delivered by a vector comprising said repair template. Also provided is a method of treating a subject, e.g., a subject in need thereof, comprising inducing transcriptional activation or repression by transforming the subject with the polynucleotide encoding the present system or any of the present vectors, wherein said polynucleotide or vector encodes or comprises the catalytically inactive CRISPR enzyme and one or more associated functional domains; the method further comprising administering a stabilizing ligand to the subject. These methods may also include delivering and/or expressing excess DD to the subject. Where any treatment is occurring ex vivo, for example in a cell culture, then it will be appreciated that the term 'subject' may be replaced by the phrase "cell or cell culture."

Compositions comprising the present system for use in said method of treatment are also provided. A separate composition may comprise the stabilizing ligand. A kit of parts may be provided including such compositions. Use of the present system in the manufacture of a medicament for such methods of treatment are also provided. Use of the present system in screening is also provided by the present invention, e.g., gain of function screens. Cells which are artificially forced to overexpress a gene are be able to down regulate the gene over time (re-establishing equilibrium) e.g. by negative feedback loops. By the time the screen starts the unregulated gene might be reduced again. Using an inducible Cpf1 activator allows one to induce transcription right before the screen and therefore minimizes the chance of false negative hits. Accordingly, by use of the instant invention in screening, e.g., gain of function screens, the chance of false negative results may be minimized.

In one aspect, the invention provides an engineered, non-naturally occurring CRISPR-Cas system comprising a DD-Cas protein and a guide RNA that targets a DNA molecule encoding a gene product in a cell, whereby the guide RNA targets the DNA molecule encoding the gene product and the Cas protein cleaves the DNA molecule encoding the gene product, whereby expression of the gene product is altered; and, wherein the Cas protein and the guide RNA do not naturally occur together. The invention comprehends the guide RNA comprising a guide sequence fused to a direct repeat sequence.

Where functional domains and the like are "associated" with one or other part of the enzyme, these are typically fusions. The term "associated with" is used here in respect of how one molecule 'associates' with respect to another, for example between parts of the CRISPR enzyme an a functional domain. The two may be considered to be tethered to each other. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (e.g. between the enzyme and the functional domain or between the adaptor protein and the functional domain). Thus, in some embodiments, the part of the CRISPR enzyme is associated with a functional domain by binding thereto. In other embodiments, the CRISPR enzyme is associated with a functional domain because the two are fused together, optionally via an intermediate linker. Examples of linkers include the GlySer linkers discussed herein. While a non-covalent bound DD may be able to initiate degradation of the associated Cas (e.g. Cpf1), proteasome degradation involves unwinding of the protein chain; and, a fusion is preferred as it can provide that the DD stays connected to Cas upon degradation. However the CRISPR enzyme and DD are brought together, in the presence of a stabilizing ligand specific for the DD, a stabilization complex is formed. This complex comprises the stabilizing ligand bound to the DD. The complex also comprises the DD associated with the CRISPR enzyme. In the absence of said stabilizing ligand, degradation of the DD and its associated CRISPR enzyme is promoted.

Destabilizing domains have general utility to confer instability to a wide range of proteins; see, e.g., Miyazaki, J Am Chem Soc. Mar. 7, 2012; 134(9): 3942-3945, incorporated herein by reference. CMP8 or 4-hydroxytamoxifen can be destabilizing domains. More generally, A temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3β.6,7 This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a CRISPR enzyme confers to the CRISPR protein degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R)12, it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a CRISPR enzyme and its stability can be regulated or perturbed using a ligand, whereby the CRISPR enzyme has a DD. Another DD can be a 12-kDa (107-amino-acid) tag based on a mutated FKBP protein, stabilized by Shield1 ligand; see, e.g., Nature Methods 5, (2008). For instance a DD can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282:24866-24872; and Rodriguez, Chem Biol. Mar. 23, 2012; 19(3): 391-398—all of which are incorporated herein by reference and may be employed in the practice of the invention in selected a DD to associate with a CRISPR enzyme in the practice of this invention. As can be seen, the knowledge in the art includes a number of DDs, and the DD can be associated with, e.g., fused to, advantageously with a linker, to a CRISPR enzyme, whereby the DD can be stabilized in the presence of a ligand and when there is the absence thereof the DD can become destabilized, whereby the CRISPR enzyme is entirely destabilized, or the DD can be stabilized in the absence of a ligand and when the ligand is present the DD can become destabilized; the DD allows the CRISPR enzyme and hence the CRISPR-Cas complex or system to be regulated or controlled—turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention is able to provide such peaks. In some senses the system is inducible. In some other senses, the system repressed in the absence of stabilizing ligand and de-repressed in the presence of stabilizing ligand. Without wishing to be bound by any theory and without making any promises, other benefits of the invention may include that it is:

Dosable (in contrast to a system that turns on or off, e.g., can allow for variable CRISPR-Cas system or complex activity).

Orthogonal, e.g., a ligand only affects its cognate DD so two or more systems can operate independently, and/or the CRISPR enzymes can be from one or more orthologs.

Transportable, e.g., may work in different cell types or cell lines.

Rapid.

Temporal Control.

Able to reduce background or off target Cas or Cas toxicity or excess buildup of Cas by allowing the Cas to be degradated.

While the DD can be at N and/or C terminal(s) of the CRISPR enzyme, including a DD at one or more sides of a split (as defined herein elsewhere) e.g. Cpf1(N)-linker-DD-linker-Cpf1(C) is also a way to introduce a DD. In some embodiments, the if using only one terminal association of DD to the CRISPR enzyme is to be used, then it is preferred to use ER50 as the DD. In some embodiments, if using both N- and C-terminals, then use of either ER50 and/or DHFR50 is preferred. Particularly good results were seen with the N-terminal fusion, which is surprising. Having both N and C terminal fusion may be synergistic. The size of Destabilization Domain varies but is typically approx.-approx. 100-300 amino acids in size. The DD is preferably an engineered destabilizing protein domain. DDs and methods for making DDs, e.g., from a high affinity ligand and its ligand binding domain. The invention may be considered to be "orthogonal" as only the specific ligand will stabilize its respective (cognate) DD, it will have no effect on the stability of non-cognate DDs. A commercially available DD system is the CloneTech, ProteoTuner™ system; the stabilizing ligand is Shield1.

In some embodiments, the stabilizing ligand is a 'small molecule'. In some embodiments, the stabilizing ligand is cell-permeable. It has a high affinity for it correspond DD. Suitable DD—stabilizing ligand pairs are known in the art. In general, the stabilizing ligand may be removed by:

Natural processing (e.g., proteasome degradation), e.g., in vivo;

Mopping up, e.g. ex vivo/cell culture, by:

Provision of a preferred binding partner; or

Provision of XS substrate (DD without Cas),

In another aspect, the invention provides an engineered, non-naturally occurring vector system comprising one or more vectors comprising a first regulatory element operably linked to a CRISPR-Cas system guide RNA that targets a DNA molecule encoding a gene product and a second regulatory element operably linked coding for a DD-Cas protein. Components (a) and (b) may be located on same or different vectors of the system. The guide RNA targets the DNA molecule encoding the gene product in a cell and the DD-Cas protein may cleaves the DNA molecule encoding the gene product (it may cleave one or both strands or have substantially no nuclease activity), whereby expression of the gene product is altered; and, wherein the DD-Cas protein and the guide RNA do not naturally occur together. In an embodiment of the invention the DD-Cas protein is a DD-Cpf1 protein.

In one aspect, the invention provides a DD-CRISPR enzyme comprising one or more nuclear localization sequences and/or NES of sufficient strength to drive accumulation of said DD-CRISPR enzyme in a detectable amount in and/or out of the nucleus of a eukaryotic cell. In some embodiments, the DD-CRISPR enzyme is a DD-Cpf1 enzyme. In some embodiments, the DD-Cpf1 enzyme is derived from *Francisella tularensis* 1, *Francisella tularensis* subsp. *novicida*, *Prevotella albensis*, *Lachnospiraceae bacterium* MC2017 1, *Butyrivibrio proteoclasticus*, *Peregrinibacteria bacterium* GW2011_GWA2 33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens*, or *Porphyromonas macacae* Cpf1 (e.g., modified to have or be associated with at least one DD), and may include further alteration or mutation of the Cpf1, and can be a chimeric Cpf1. In some embodiments, the DD-CRISPR enzyme is codon-optimized for expression in a eukaryotic cell. In some embodiments, the DD-CRISPR enzyme directs cleavage of one or two strands at the location of the target sequence. In some embodiments, the DD-CRISPR enzyme lacks or substantially DNA strand cleavage activity (e.g., no more than 5% nuclease activity as compared with a wild type enzyme or enzyme not having the mutation or alteration that decreases nuclease activity).

In a further aspect, the invention involves a computer-assisted method for identifying or designing potential compounds to fit within or bind to DD-CRISPR-Cpf1 system or a functional portion thereof or vice versa (as described herein elsewhere e.g. under "protected guides") In particular embodiments of the invention, the conformational variations in the crystal structures of the DD-CRISPR-Cpf1 system or of components of the DD-CRISPR-Cpf1 provide important and critical information about the flexibility or movement of protein structure regions relative to nucleotide (RNA or DNA) structure regions that may be important for DD-CRISPR-Cas system function. The structural information provided for Cpf1 in the herein cited materials may be used to further engineer and optimize the herein DD-CRISPR-Cas system and this may be extrapolated to interrogate structure-function relationships in other CRISPR enzyme, e.g., DD-CRISPR enzyme systems as well, e.g, other Type V CRISPR enzyme systems (for instance other Type V DD-CRISPR enzyme systems). The invention comprehends optimized functional DD-CRISPR-Cas enzyme systems. In particular the DD-CRISPR enzyme comprises one or more mutations that converts it to a DNA binding protein to which functional domains exhibiting a function of interest may be recruited or appended or inserted or attached. In certain embodiments, the CRISPR enzyme comprises one or more mutations in a RuvC1 of the DD-CRISPR enzyme and/or is a mutation as otherwise as discussed herein. In some embodiments, the DD-CRISPR enzyme has one or more mutations in a catalytic domain, wherein when transcribed the guide sequence directs sequence-specific binding of a DD-CRISPR complex to the target sequence, and wherein the enzyme further comprises a functional domain (e.g., for providing the destabilized domain or contributing thereto). The structural information provided in the herein cited materials allows for interrogation of guide interaction with the target DNA and the CRISPR enzyme (e.g., Cpf1; for instance DD-CRISPR enzyme, e.g., DD-Cpf1)) permitting engineering or alteration of sgRNA structure to optimize functionality of the entire DD-CRISPR-Cas system. For example, loops of the guide may be extended, without colliding with the Cpf1 protein by the insertion of adaptor proteins that can bind to RNA. These adaptor proteins can further recruit effector proteins or fusions which comprise one or more functional domains. The functional domain may comprise, consist essentially of or consist of a transcriptional activation domain, e.g. VP64. The functional domain may comprise, consist essentially of a transcription repression domain, e.g., KRAB. In some embodiments, the transcription repression domain is or comprises or consists essentially of SID, or concatemers of SID (eg SID4X). In some embodiments, the functional domain comprise, consist essentially of an epigenetic modifying domain, such that an epigenetic modifying enzyme is provided. In some embodiments, the functional domain comprise, consist essentially of an activation domain, which may be the P65 activation domain.

Aspects of the invention encompass a non-naturally occurring or engineered composition that may comprise a guide RNA (gRNA) comprising a guide sequence capable of hybridizing to a target sequence in a genomic locus of interest in a cell and a DD-CRISPR enzyme that may comprise at least one or more nuclear localization sequences, wherein the DD-CRISPR enzyme comprises one or two or more mutations, such that the enzyme has altered or diminished nuclease activity compared with the wild type enzyme, wherein at least one loop of the gRNA is modified by the insertion of distinct RNA sequence(s) that bind to one or more adaptor proteins, and wherein the adaptor protein further recruits one or more heterologous functional domains. In an embodiment of the invention the DD-CRISPR enzyme comprises one or two or more mutations In another embodiment, the functional domain comprise, consist essentially of a transcriptional activation domain, e.g., VP64. In another embodiment, the functional domain comprise, consist essentially of a transcriptional repressor domain, e.g., KRAB domain, SID domain or a SID4X domain. In embodiments of the invention, the one or more heterologous functional domains have one or more activities selected from the group comprising, consisting essentially of, or consisting of methylase activity, demethylase activity, transcription activation activity, transcription repression activity, transcription release factor activity, histone modification activity, RNA cleavage activity and nucleic acid binding activity. In futher embodiments of the invention the cell is a eukaryotic cell or a mammalian cell or a human cell. In further embodiments, the adaptor protein is selected from the group comprising, consisting essentially of, or consisting of MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. In another embodiment, the at least one loop of the gRNA is tetraloop and/or loop2. An aspect of the invention emcompasses methods of modifying a genomic locus of interest to change gene expression in a cell by introducing into the cell any of the compositions described herein.

An aspect of the invention is that the above elements are comprised in a single composition or comprised in individual compositions. These compositions may advantageously be applied to a host to elicit a functional effect on the genomic level.

In general, the gRNA are modified in a manner that provides specific binding sites (e.g., aptamers) for adapter proteins comprising one or more functional domains (e.g., via fusion protein) to bind to. The modified sgRNA are modified such that once the gRNA forms a DD-CRISPR complex (i.e. DD-CRISPR enzyme binding to gRNA and target) the adapter proteins bind and, the functional domain on the adapter protein is positioned in a spatial orientation which is advantageous for the attributed function to be effective. For example, if the functional domain comprise, consist essentially of a transcription activator (e.g., VP64 or p65), the transcription activator is placed in a spatial orientation which allows it to affect the transcription of the target. Likewise, a transcription repressor will be advantageously positioned to affect the transcription of the target and a nuclease (e.g., Fok1) will be advantageously positioned to cleave or partially cleave the target.

The skilled person will understand that modifications to the gRNA which allow for binding of the adapter+functional domain but not proper positioning of the adapter+functional domain (e.g., due to steric hinderance within the three dimensial structure of the CRISPR complex) are modifications which are not intended. The one or more modified gRNA may be modified at the tetra loop, the stem loop 1, stem loop 2, or stem loop 3, as described herein, preferably at either the tetra loop or stem loop 2, and most preferably at both the tetra loop and stem loop 2.

As explained herein the functional domains may be, for example, one or more domains from the group comprising, consisting essentially of, or consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). In some cases it is advantageous that additionally at least one NLS and/or NES is provided. In some instances, it is advantageous to position the NLS and/or NES at the N terminus. When more than one functional domain is included, the functional domains may be the same or different.

The gRNA may be designed to include multiple binding recognition sites (e.g., aptamers) specific to the same or different adapter protein. The gRNA may be designed to bind to the promoter region –1000-+1 nucleic acids upstream of the transcription start site (i.e. TSS), preferably –200 nucleic acids. This positioning improves functional domains which affect gene activation (e.g., transcription activators) or gene inhibition (e.g., transcription repressors). The modified gRNA may be one or more modified gRNAs targeted to one or more target loci (e.g., at least 1 gRNA, at least 2 gRNA, at least 5 gRNA, at least 10 gRNA, at least 20 gRNA, at least 30 g RNA, at least 50 gRNA) comprised in a composition.

Further, the DD-CRISPR enzyme with diminished nuclease activity is most effective when the nuclease activity is inactivated (e.g., nuclease inactivation of at least 70%, at least 80%, at least 90%, at least 95%, at least 97%, or 100% as compared with the wild type enzyme; or to put in another way, a DD-Cpf1 enzyme or DD-CRISPR enzyme having advantageously about 0% of the nuclease activity of the non-mutated or wild type Cpf1 enzyme or CRISPR enzyme, or no more than about 3% or about 5% or about 10% of the nuclease activity of the non-mutated or wild type Cpf1 enzyme or CRISPR enzyme). This is possible by introducing mutations into the RuvC nuclease domain of the Cpf1 and orthologs thereof. The inactivated CRISPR enzyme may have associated (e.g., via fusion protein) one or more functional domains, e.g., at least one destabilizing domain; or, for instance like those as described herein for the modified gRNA adaptor proteins, including for example, one or more domains from the group comprising, consisting essentially of, or consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). Preferred domains are Fok1, VP64, P65, HSF1, MyoD1. In the event that Fok1 is provided, it is advantageous that multiple Fok1 functional domains are provided to allow for a functional dimer and that gRNAs are designed to provide proper spacing for functional use (Fok1) as specifically described in Tsai et al. Nature Biotechnology, Vol. 32, Number 6, June 2014). The adaptor protein may utilize known linkers to attach such functional domains. In some cases it is advantageous that additionally at least one NLS or NES is provided. In some instances, it is advantageous to position the NLS or NES at the N terminus. When more than one functional domain is included, the functional domains may be the same or different. In general, the positioning of the one or more functional domain on the inactivated DD-CRISPR enzyme is one which allows for correct spatial orientation for the functional domain to affect the target with the attributed functional effect. For example, if the functional domain is a transcription activator (e.g., VP64 or p65), the transcription activator is placed in a spatial orientation which allows it to affect the transcription of the target. Likewise, a transcription repressor will be advantageously positioned to affect the transcription of the target, and a nuclease (e.g., Fok1) will be advantageously positioned to cleave or partially cleave the target. This may include positions other than the N-/C-terminus of the DD-CRISPR enzyme.

An adaptor protein may be any number of proteins that binds to an aptamer or recognition site introduced into the modified gRNA and which allows proper positioning of one or more functional domains, once the gRNA has been incorporated into the DD-CRISPR complex, to affect the target with the attributed function. As explained in detail in this application such may be coat proteins, preferably bacteriophage coat proteins. The functional domains associated with such adaptor proteins (e.g., in the form of fusion protein) may include, for example, one or more domains from the group comprising, consisting essentially of, or consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). Preferred domains are Fok1, VP64, P65, HSF1, MyoD1. In the event that the functional domain is a transcription activator or transcription repressor it is advantageous that additionally at least an NLS or NES is provided and preferably at the N terminus. When more than one functional domain is included, the functional domains may be the same or different. The adaptor protein may utilize known linkers to attach such functional domains. Such linkers may be used to associate the DD with the CRISPR enzyme or have the CRISPR enzyme comprise the DD.

In some embodiments, phenotypic alteration is preferably the result of genome modification when a genetic disease is targeted, especially in methods of therapy and preferably where a repair template is provided to correct or alter the phenotype.

In some embodiments diseases that may be targeted include those concerned with disease-causing splice defects.

In some embodiments, cellular targets include Hemopoietic Stem/Progenitor Cells (CD34+); Human T cells; and Eye (retinal cells)—for example photoreceptor precursor cells.

In some embodiments Gene targets include: Human Beta Globin—HBB (for treating Sickle Cell Anemia, including by stimulating gene-conversion (using closely related HBD gene as an endogenous template)); CD3 (T-Cells); and CEP920—retina (eye).

In some embodiments disease targets also include: cancer; Sickle Cell Anemia (based on a point mutation); HBV, HIV; Beta-Thalassemia; and ophthalmic or ocular disease—for example Leber Congenital Amaurosis (LCA)-causing Splice Defect.

In some embodiments delivery methods include: Cationic Lipid Mediated "direct" delivery of Enzyme-Guide complex (RiboNucleoProtein) and electroporation of plasmid DNA.

Methods, products and uses described herein may be used for non-therapeutic purposes. Furthermore, any of the methods described herein may be applied in vitro and ex vivo.

In an aspect, provided is a non-naturally occurring or engineered composition comprising:
I. two or more CRISPR-Cas system polynucleotide sequences comprising
   (a) a first guide sequence capable of hybridizing to a first target sequence in a polynucleotide locus,
   (b) a second guide sequence capable of hybridizing to a second target sequence in a polynucleotide locus,
   (c) a direct repeat sequence, and
II. a Cpf1 enzyme or a second polynucleotide sequence encoding it,
wherein the Cpf1 enzyme is a modified enzyme comprising one or more DD as described herein,
wherein when transcribed, the first and the second guide sequences direct sequence-specific binding of a first and a second CRISPR complex to the first and second target sequences respectively,
wherein the first CRISPR complex comprises the Cpf1 enzyme complexed with the first guide sequence that is hybridizable to the first target sequence,
wherein the second CRISPR complex comprises the Cpf1 enzyme complexed with the second guide sequence that is hybridizable to the second target sequence, and
wherein the first guide sequence directs cleavage of one strand of the DNA duplex near the first target sequence and the second guide sequence directs cleavage of the other strand near the second target sequence inducing a double strand break, thereby modifying the organism or the non-human or non-animal organism.

In another embodiment, the Cpf1 is delivered into the cell as a protein. In another and particularly preferred embodiment, the Cpf1 is delivered into the cell as a protein or as a nucleotide sequence encoding it. Delivery to the cell as a protein may include delivery of a Ribonucleoprotein (RNP) complex, where the protein is complexed with the guide.

In an aspect, host cells and cell lines modified by or comprising the compositions, systems or modified enzymes of present invention are provided, including stem cells, and progeny thereof.

In an aspect, methods of cellular therapy are provided, where, for example, a single cell or a population of cells is sampled or cultured, wherein that cell or cells is or has been modified ex vivo as described herein, and is then re-introduced (sampled cells) or introduced (cultured cells) into the organism. Stem cells, whether embryonic or induce pluripotent or totipotent stem cells, are also particularly preferred in this regard. But, of course, in vivo embodiments are also envisaged.

Inventive methods can further comprise delivery of templates, such as repair templates, which may be dsODN or ssODN, see below. Delivery of templates may be via the cotemporaneous or separate from delivery of any or all the CRISPR enzyme or guide and via the same delivery mechanism or different. In some embodiments, it is preferred that the template is delivered together with the guide and, preferably, also the CRISPR enzyme. An example may be an AAV vector where the CRISPR enzyme is AsCpf1 or LbCpf1.

Inventive methods can further comprise: (a) delivering to the cell a double-stranded oligodeoxynucleotide (dsODN) comprising overhangs complimentary to the overhangs created by said double strand break, wherein said dsODN is integrated into the locus of interest; or—(b) delivering to the cell a single-stranded oligodeoxynucleotide (ssODN), wherein said ssODN acts as a template for homology directed repair of said double strand break. Inventive methods can be for the prevention or treatment of disease in an individual, optionally wherein said disease is caused by a defect in said locus of interest. Inventive methods can be conducted in vivo in the individual or ex vivo on a cell taken from the individual, optionally wherein said cell is returned to the individual.

The invention also comprehends products obtained from using CRISPR enzyme or Cas enzyme or Cpf1 enzyme or CRISPR-CRISPR enzyme or CRISPR-Cas system or CRISPR-Cpf1 system of the invention.

Enzymes according to the invention used in a multiplex (tandem) targeting approach. The inventors have shown that CRISPR enzymes as defined herein can employ more than one RNA guide without losing activity. This enables the use of the CRISPR enzymes, systems or complexes as defined herein for targeting multiple DNA targets, genes or gene loci, with a single enzyme, system or complex as defined herein. The guide RNAs may be tandemly arranged, optionally separated by a nucleotide sequence such as a direct repeat as defined herein. The position of the different guide RNAs is the tandem does not influence the activity. It is noted that the terms "CRISPR-Cas system", "CRISP-Cas complex" "CRISPR complex" and "CRISPR system" are used interchangeably. Also the terms "CRISPR enzyme", "Cas enzyme", or "CRISPR-Cas enzyme", can be used interchangeably. In preferred embodiments, said CRISPR enzyme, CRISP-Cas enzyme or Cas enzyme is Cpf1, or any one of the modified or mutated variants thereof described herein elsewhere.

In one aspect, the invention provides a non-naturally occurring or engineered CRISPR enzyme, preferably a class 2 CRISPR enzyme, preferably a Type V or VI CRISPR enzyme as described herein, such as without limitation Cpf1 as described herein elsewhere, used for tandem or multiplex targeting. It is to be understood that any of the CRISPR (or CRISPR-Cas or Cas) enzymes, complexes, or systems according to the invention as described herein elsewhere may be used in such an approach. Any of the methods, products, compositions and uses as described herein elsewhere are equally applicable with the multiplex or tandem targeting approach further detailed below. By means of further guidance, the following particular aspects and embodiments are provided.

In one aspect, the invention provides for the use of a Cpf1 enzyme, complex or system as defined herein for targeting multiple gene loci. In one embodiment, this can be established by using multiple (tandem or multiplex) guide RNA (gRNA) sequences.

In one aspect, the invention provides methods for using one or more elements of a Cpf1 enzyme, complex or system as defined herein for tandem or multiplex targeting, wherein said CRISP system comprises multiple guide RNA sequences. Preferably, said gRNA sequences are separated by a nucleotide sequence, such as a direct repeat as defined herein elsewhere.

The Cpf1 enzyme, system or complex as defined herein provides an effective means for modifying multiple target polynucleotides. The Cpf1 enzyme, system or complex as defined herein has a wide variety of utility including modifying (e.g., deleting, inserting, translocating, inactivating, activating) one or more target polynucleotides in a multiplicity of cell types. As such the Cpf1 enzyme, system or complex as defined herein of the invention has a broad spectrum of applications in, e.g., gene therapy, drug screening, disease diagnosis, and prognosis, including targeting multiple gene loci within a single CRISPR system.

In one aspect, the invention provides a Cpf1 enzyme, system or complex as defined herein, i.e. a Cpf1 CRISPR-Cas complex having a Cpf1 protein having at least one destabilization domain associated therewith, and multiple guide RNAs that target multiple nucleic acid molecules such as DNA molecules, whereby each of said multiple guide RNAs specifically targets its corresponding nucleic acid molecule, e.g., DNA molecule. Each nucleic acid molecule target, e.g., DNA molecule can encode a gene product or encompass a gene locus. Using multiple guide RNAs hence enables the targeting of multiple gene loci or multiple genes. In some embodiments the Cpf1 enzyme may cleave the DNA molecule encoding the gene product. In some embodiments expression of the gene product is altered. The Cpf1 protein and the guide RNAs do not naturally occur together. The Cpf1 enzyme may form part of a CRISPR system or complex, which further comprises tandemly arranged guide RNAs (gRNAs) comprising a series of 2, 3, 4, 5, 6, 7, 8, 9, 10, 15, 25, 25, 30, or more than 30 guide sequences, each capable of specifically hybridizing to a target sequence in a genomic locus of interest in a cell. In some embodiments, the functional Cpf1 CRISPR system or complex binds to the multiple target sequences. In some embodiments, the functional CRISPR system or complex may edit the multiple target sequences, e.g., the target sequences may comprise a genomic locus, and in some embodiments there may be an alteration of gene expression. In some embodiments, the functional CRISPR system or complex may comprise further functional domains. In some embodiments, the invention provides a method for altering or modifying expression of multiple gene products. The method may comprise introducing into a cell containing said target nucleic acids, e.g., DNA molecules, or containing and expressing target nucleic acid, e.g., DNA molecules; for instance, the target nucleic acids may encode gene products or provide for expression of gene products (e.g., regulatory sequences).

In preferred embodiments the CRISPR enzyme used for multiplex targeting is Cpf1, or the CRISPR system or complex comprises Cpf1. In some embodiments, the CRISPR enzyme used for multiplex targeting is AsCpf1, or the CRISPR system or complex used for multiplex targeting comprises an AsCpf1. In some embodiments, the CRISPR enzyme is an LbCpf1, or the CRISPR system or complex comprises LbCpf1. In some embodiments, the Cpf1 enzyme used for multiplex targeting cleaves both strands of DNA to produce a double strand break (DSB). In some embodiments, the CRISPR enzyme used for multiplex targeting is a nickase. In some embodiments, the Cpf1 enzyme used for multiplex targeting is a dual nickase. In some embodiments, the Cpf1 enzyme used for multiplex targeting is a Cpf1 enzyme such as a DD Cpf1 enzyme as defined herein elsewhere.

In some general embodiments, the Cpf1 enzyme used for multiplex targeting is associated with one or more functional domains. In some more specific embodiments, the CRISPR enzyme used for multiplex targeting is a deadCpf1 as defined herein elsewhere.

Also provided is a model that constitutively expresses the Cpf1 enzyme, complex or system as used herein for use in multiplex targeting. The organism may be transgenic and may have been transfected with the present vectors or may be the offspring of an organism so transfected. In a further aspect, the present invention provides compositions comprising the CRISPR enzyme, system and complex as defined herein or the polynucleotides or vectors described herein. Also provides are Cpf1 CRISPR systems or complexes comprising multiple guide RNAs, preferably in a tandemly arranged format. Said different guide RNAs may be separated by nucleotide sequences such as direct repeats.

Also provided is a method of treating a subject, e.g., a subject in need thereof, comprising inducing gene editing by transforming the subject with the polynucleotide encoding the Cpf1 CRISPR system or complex or any of polynucleotides or vectors described herein and administering them to the subject. A suitable repair template may also be provided, for example delivered by a vector comprising said repair template. Also provided is a method of treating a subject, e.g., a subject in need thereof, comprising inducing transcriptional activation or repression of multiple target gene loci by transforming the subject with the polynucleotides or vectors described herein, wherein said polynucleotide or vector encodes or comprises the Cpf1 enzyme, complex or system comprising multiple guide RNAs, preferably tandemly arranged. Where any treatment is occurring ex vivo, for example in a cell culture, then it will be appreciated that the term 'subject' may be replaced by the phrase "cell or cell culture."

Compositions comprising Cpf1 enzyme, complex or system comprising multiple guide RNAs, preferably tandemly arranged, or the polynucleotide or vector encoding or comprising said Cpf1 enzyme, complex or system comprising multiple guide RNAs, preferably tandemly arranged, for use in the methods of treatment as defined herein elsewhere are also provided. A kit of parts may be provided including such compositions. Use of said composition in the manufacture of a medicament for such methods of treatment are also provided. Use of a Cpf1 CRISPR system in screening is also provided by the present invention, e.g., gain of function screens. Cells which are artificially forced to overexpress a gene are be able to down regulate the gene over time (re-establishing equilibrium) e.g. by negative feedback loops. By the time the screen starts the unregulated gene might be reduced again. Using an inducible Cpf1 activator allows one to induce transcription right before the screen and therefore minimizes the chance of false negative hits. Accordingly, by use of the instant invention in screening, e.g., gain of function screens, the chance of false negative results may be minimized.

In some embodiments, a host cell is transiently or non-transiently transfected with one or more vectors comprising the polynucleotides encoding the Cpf1 enzyme, system or complex for use in multiple targeting as defined herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art and exemplified herein elsewhere. Cell lines are available from a variety of sources known to those with skill in the art (see, e.g., the American Type Culture Collection (ATCC) (Manassas, Va.)). In some embodiments, a cell transfected with one or more vectors comprising the polynucleotides encoding the Cpf1 enzyme, system or complex for use in multiple targeting as defined herein is used to establish a new cell line comprising one or more vector-derived sequences. In some embodiments, a cell transiently transfected with the components of a Cpf1 CRISPR system or complex for use in multiple targeting as described herein (such as by transient transfection of one or more vectors, or transfection with RNA), and modified through the activity of a Cpf1 CRISPR system or complex, is used to establish a new cell line comprising cells containing the modification but lacking any other exogenous sequence. In some embodiments, cells transiently or non-transiently transfected with one or more vectors comprising the polynucleotides encoding the Cpf1 enzyme, system or complex for use in multiple targeting as defined herein, or cell lines derived from such cells are used in assessing one or more test compounds.

The term "regulatory element" is as defined herein elsewhere.

Advantageous vectors include lentiviruses and adeno-associated viruses, and types of such vectors can also be selected for targeting particular types of cells.

In some embodiments, the Cpf1 enzyme is a type V or VI CRISPR system enzyme. In some embodiments, the Cpf1 enzyme is a Cpf1 enzyme. In some embodiments, the Cpf1 enzyme is derived from *Francisella tularensis* 1, *Francisella tularensis* subsp. *novicida*, *Prevotella albensis*, *Lachnospiraceae bacterium* MC2017 1, *Butyrivibrio proteoclasticus*, *Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum*, *Eubacterium eligens*, *Moraxella bovoculi* 237, *Leptospira inadai*, *Lachnospiraceae bacterium* ND2006, *Porphyromonas crevioricanis* 3, *Prevotella disiens*, or *Porphyromonas macacae* Cpf1, and may include further alterations or mutations of the Cpf1 as defined herein elsewhere, and can be a chimeric Cpf1. When multiple guide RNAs are used, they are preferably separated by a direct repeat sequence.

In one aspect, the invention provides a method of modifying multiple target polynucleotides in a host cell such as a eukaryotic cell. In some embodiments, the method comprises allowing a Cpf1 CRISPR complex to bind to multiple target polynucleotides, e.g., to effect cleavage of said multiple target polynucleotides, thereby modifying multiple target polynucleotides, wherein the Cpf1 CRISPR complex comprises a Cpf1 enzyme complexed with multiple guide sequences each of the being hybridized to a specific target sequence within said target polynucleotide, wherein said multiple guide sequences are linked to a direct repeat sequence. In some embodiments, said cleavage comprises cleaving one or two strands at the location of each of the target sequence by said Cpf1 enzyme. In some embodiments, said cleavage results in decreased transcription of the multiple target genes. In some embodiments, the method further comprises repairing one or more of said cleaved target polynucleotide by homologous recombination with an exogenous template polynucleotide, wherein said repair results in a mutation comprising an insertion, deletion, or substitution of one or more nucleotides of one or more of said target polynucleotides. In some embodiments, said mutation results in one or more amino acid changes in a protein expressed from a gene comprising one or more of the target sequence(s). In some embodiments, the method further comprises delivering one or more vectors to said eukaryotic cell, wherein the one or more vectors drive expression of one or more of: the Cpf1 enzyme and the multiple guide RNA sequence linked to a direct repeat sequence. In some embodiments, said vectors are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject.

An aspect of the invention is that the above elements are comprised in a single composition or comprised in individual compositions. These compositions may advantageously be applied to a host to elicit a functional effect on the genomic level.

Each gRNA may be designed to include multiple binding recognition sites (e.g., aptamers) specific to the same or different adapter protein. Each gRNA may be designed to bind to the promoter region −1000-+1 nucleic acids upstream of the transcription start site (i.e. TSS), preferably −200 nucleic acids. This positioning improves functional domains which affect gene activation (e.g., transcription activators) or gene inhibition (e.g., transcription repressors). The modified gRNA may be one or more modified gRNAs targeted to one or more target loci (e.g., at least 1 gRNA, at least 2 gRNA, at least 5 gRNA, at least 10 gRNA, at least 20 gRNA, at least 30 g RNA, at least 50 gRNA) comprised in a composition. Said multiple gRNA sequences can be tandemly arranged and are preferably separated by a direct repeat.

In some embodiments, phenotypic alteration is preferably the result of genome modification when a genetic disease is targeted, especially in methods of therapy and preferably where a repair template is provided to correct or alter the phenotype.

In some embodiments diseases that may be targeted include those concerned with disease-causing splice defects.

In some embodiments, cellular targets include Hemopoietic Stem/Progenitor Cells (CD34+); Human T cells; and Eye (retinal cells)—for example photoreceptor precursor cells.

In some embodiments Gene targets include: Human Beta Globin—HBB (for treating Sickle Cell Anemia, including by stimulating gene-conversion (using closely related HBD gene as an endogenous template)); CD3 (T-Cells); and CEP920—retina (eye).

In some embodiments disease targets also include: cancer; Sickle Cell Anemia (based on a point mutation); HBV, HIV; Beta-Thalassemia; and ophthalmic or ocular disease—for example Leber Congenital Amaurosis (LCA)-causing Splice Defect.

In some embodiments delivery methods include: Cationic Lipid Mediated "direct" delivery of Enzyme-Guide complex (RiboNucleoProtein) and electroporation of plasmid DNA.

Methods, products and uses described herein may be used for non-therapeutic purposes. Furthermore, any of the methods described herein may be applied in vitro and ex vivo.

In an aspect, provided is a non-naturally occurring or engineered composition comprising:

I. two or more CRISPR-Cas system polynucleotide sequences comprising
(a) a first guide sequence capable of hybridizing to a first target sequence in a polynucleotide locus,
(b) a second guide sequence capable of hybridizing to a second target sequence in a polynucleotide locus,
(c) a direct repeat sequence,
and
II. a Cpf1 enzyme or a second polynucleotide sequence encoding it,
wherein when transcribed, the first and the second guide sequences direct sequence-specific binding of a first and a second Cpf1 CRISPR complex to the first and second target sequences respectively,
wherein the first CRISPR complex comprises the Cpf1 enzyme complexed with the first guide sequence that is hybridizable to the first target sequence,
wherein the second CRISPR complex comprises the Cpf1 enzyme complexed with the second guide sequence that is hybridizable to the second target sequence, and
wherein the first guide sequence directs cleavage of one strand of the DNA duplex near the first target sequence and the second guide sequence directs cleavage of the other strand near the second target sequence inducing a double strand break, thereby modifying the organism or the non-human or non-animal organism. Similarly, compositions comprising more than two guide RNAs can be envisaged e.g. each specific for one target, and arranged tandemly in the composition or CRISPR system or complex as described herein.

In another embodiment, the Cpf1 is delivered into the cell as a protein. In another and particularly preferred embodiment, the Cpf1 is delivered into the cell as a protein or as a nucleotide sequence encoding it. Delivery to the cell as a protein may include delivery of a Ribonucleoprotein (RNP) complex, where the protein is complexed with the multiple guides.

In an aspect, host cells and cell lines modified by or comprising the compositions, systems or modified enzymes of present invention are provided, including stem cells, and progeny thereof.

In an aspect, methods of cellular therapy are provided, where, for example, a single cell or a population of cells is sampled or cultured, wherein that cell or cells is or has been modified ex vivo as described herein, and is then re-introduced (sampled cells) or introduced (cultured cells) into the organism. Stem cells, whether embryonic or induce pluripotent or totipotent stem cells, are also particularly preferred in this regard. But, of course, in vivo embodiments are also envisaged.

Inventive methods can further comprise delivery of templates, such as repair templates, which may be dsODN or ssODN, see below. Delivery of templates may be via the cotemporaneous or separate from delivery of any or all the CRISPR enzyme or guide RNAs and via the same delivery mechanism or different. In some embodiments, it is preferred that the template is delivered together with the guide RNAs and, preferably, also the CRISPR enzyme. An example may be an AAV vector where the CRISPR enzyme is AsCpf1 or LbCpf1.

Inventive methods can further comprise: (a) delivering to the cell a double-stranded oligodeoxynucleotide (dsODN) comprising overhangs complimentary to the overhangs created by said double strand break, wherein said dsODN is integrated into the locus of interest; or—(b) delivering to the cell a single-stranded oligodeoxynucleotide (ssODN), wherein said ssODN acts as a template for homology directed repair of said double strand break. Inventive methods can be for the prevention or treatment of disease in an individual, optionally wherein said disease is caused by a defect in said locus of interest. Inventive methods can be conducted in vivo in the individual or ex vivo on a cell taken from the individual, optionally wherein said cell is returned to the individual.

The invention also comprehends products obtained from using CRISPR enzyme or Cas enzyme or Cpf1 enzyme or CRISPR-CRISPR enzyme or CRISPR-Cas system or CRISPR-Cpf1 system for use in tandem or multiple targeting as defined herein.

Guide RNA According to the Invention Comprising a Dead Guide Sequence

In one aspect, the invention provides guide sequences which are modified in a manner which allows for formation of the CRISPR complex and successful binding to the target, while at the same time, not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Nuclease activity may be measured using surveyor analysis or deep sequencing as commonly used in the art, preferably surveyor analysis. Similarly, dead guide sequences may not sufficiently engage in productive base pairing with respect to the ability to promote catalytic activity or to distinguish on-target and off-target binding activity. Briefly, the surveyor assay involves purifying and amplifying a CRISPR target site for a gene and forming heteroduplexes with primers amplifying the CRISPR target site. After re-anneal, the products are treated with SURVEYOR nuclease and SURVEYOR enhancer S (Transgenomics) following the manufacturer's recommended protocols, analyzed on gels, and quantified based upon relative band intensities.

Hence, in a related aspect, the invention provides a non-naturally occurring or engineered composition Cpf1 CRISPR-Cas system comprising a functional Cpf1 as described herein, and guide RNA (gRNA) wherein the gRNA comprises a dead guide sequence whereby the gRNA is capable of hybridizing to a target sequence such that the Cpf1 CRISPR-Cas system is directed to a genomic locus of interest in a cell without detectable indel activity resultant from nuclease activity of a non-mutant Cpf1 enzyme of the system as detected by a SURVEYOR assay. For shorthand purposes, a gRNA comprising a dead guide sequence whereby the gRNA is capable of hybridizing to a target sequence such that the Cpf1CRISPR-Cas system is directed to a genomic locus of interest in a cell without detectable indel activity resultant from nuclease activity of a non-mutant Cpf1 enzyme of the system as detected by a SURVEYOR assay is herein termed a "dead gRNA". It is to be understood that any of the gRNAs according to the invention as described herein elsewhere may be used as dead gRNAs/gRNAs comprising a dead guide sequence as described herein below. Any of the methods, products, compositions and uses as described herein elsewhere is equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to a target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

As explained further herein, several structural parameters allow for a proper framework to arrive at such dead guides. Dead guide sequences are shorter than respective guide sequences which result in active Cpf1-specific indel formation. Dead guides are 5%, 10%, 20%, 30%, 40%, 50%, shorter than respective guides directed to the same Cpf1 leading to active Cpf1-specific indel formation.

As explained below and known in the art, one aspect of gRNA-Cpf1 specificity is the direct repeat sequence, which is to be appropriately linked to such guides. In particular, this implies that the direct repeat sequences are designed dependent on the origin of the Cpf1. Thus, structural data available for validated dead guide sequences may be used for designing Cpf1 specific equivalents. Structural similarity between, e.g., the orthologous nuclease domains RuvC of two or more Cpf1 effector proteins may be used to transfer design equivalent dead guides. Thus, the dead guide herein may be appropriately modified in length and sequence to reflect such Cpf1 specific equivalents, allowing for formation of the CRISPR complex and successful binding to the target, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets, for example for activation, repression and/or silencing of gene activity, has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides now allow for the first time to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble a synthetic transcription activation complex consisting of multiple distinct effector domains. Such may be modeled after natural transcription activation processes. For example, an aptamer, which selectively binds an effector (e.g. an activator or repressor; dimerized MS2 bacteriophage coat proteins as fusion proteins with an activator or repressor), or a protein which itself binds an effector (e.g. activator or repressor) may be appended to a dead gRNA tetraloop and/or a stem-loop 2. In the case of MS2, the fusion protein MS2-VP64 binds to the tetraloop and/or stem-loop 2 and in turn mediates transcriptional up-regulation, for example for Neurog2. Other transcriptional activators are, for example, VP64. P65, HSF1, and MyoD1. By mere example of this concept, replacement of the MS2 stem-loops with PP7-interacting stem-loops may be used to recruit repressive elements.

Thus, one aspect is a gRNA of the invention which comprises a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The gene effectors, gene activators, gene repressors may be present in the form of fusion proteins.

In an embodiment, the dead gRNA as described herein or the Cpf1 CRISPR-Cas complex as described herein includes a non-naturally occurring or engineered composition comprising two or more adaptor proteins, wherein each protein is associated with one or more functional domains and wherein the adaptor protein binds to the distinct RNA sequence(s) inserted into the at least one loop of the dead gRNA.

Hence, an aspect provides a non-naturally occurring or engineered composition comprising a guide RNA (gRNA) comprising a dead guide sequence capable of hybridizing to a target sequence in a genomic locus of interest in a cell, wherein the dead guide sequence is as defined herein, a Cpf1 comprising at least one or more nuclear localization sequences, wherein the Cpf1 optionally comprises at least one mutation wherein at least one loop of the dead gRNA is modified by the insertion of distinct RNA sequence(s) that bind to one or more adaptor proteins, and wherein the adaptor protein is associated with one or more functional domains; or, wherein the dead gRNA is modified to have at least one non-coding functional loop, and wherein the composition comprises two or more adaptor proteins, wherein the each protein is associated with one or more functional domains.

In certain embodiments, the adaptor protein is a fusion protein comprising the functional domain, the fusion protein optionally comprising a linker between the adaptor protein and the functional domain, the linker optionally including a GlySer linker.

In certain embodiments, the at least one loop of the dead gRNA is not modified by the insertion of distinct RNA sequence(s) that bind to the two or more adaptor proteins.

In certain embodiments, the one or more functional domains associated with the adaptor protein is a transcriptional activation domain.

In certain embodiments, the one or more functional domains associated with the adaptor protein is a transcriptional activation domain comprising VP64, p65, MyoD1, HSF1, RTA or SET7/9.

In certain embodiments, the one or more functional domains associated with the adaptor protein is a transcriptional repressor domain.

In certain embodiments, the transcriptional repressor domain is a KRAB domain.

In certain embodiments, the transcriptional repressor domain is a NuE domain, NcoR domain, SID domain or a SID4X domain.

In certain embodiments, at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity.

In certain embodiments, the DNA cleavage activity is due to a Fok1 nuclease.

In certain embodiments, the dead gRNA is modified so that, after dead gRNA binds the adaptor protein and further binds to the Cpf1 and target, the functional domain is in a spatial orientation allowing for the functional domain to function in its attributed function.

In certain embodiments, the at least one loop of the dead gRNA is tetra loop and/or loop2. In certain embodiments, the tetra loop and loop 2 of the dead gRNA are modified by the insertion of the distinct RNA sequence(s).

In certain embodiments, the insertion of distinct RNA sequence(s) that bind to one or more adaptor proteins is an aptamer sequence. In certain embodiments, the aptamer sequence is two or more aptamer sequences specific to the same adaptor protein. In certain embodiments, the aptamer sequence is two or more aptamer sequences specific to different adaptor protein.

In certain embodiments, the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1.

In certain embodiments, a first adaptor protein is associated with a p65 domain and a second adaptor protein is associated with a HSF1 domain.

In certain embodiments, the composition comprises a Cpf1 CRISPR-Cas complex having at least three functional domains, at least one of which is associated with the Cpf1 and at least two of which are associated with dead gRNA.

In certain embodiments, the composition further comprises a second gRNA, wherein the second gRNA is a live gRNA capable of hybridizing to a second target sequence such that a second Cpf1 CRISPR-Cas system is directed to a second genomic locus of interest in a cell with detectable indel activity at the second genomic locus resultant from nuclease activity of the Cpf1 enzyme of the system.

In certain embodiments, the composition further comprises a plurality of dead gRNAs and/or a plurality of live gRNAs.

One aspect of the invention is to take advantage of the modularity and customizability of the gRNA scaffold to establish a series of gRNA scaffolds with different binding sites (in particular aptamers) for recruiting distinct types of effectors in an orthogonal manner. Again, for matters of example and illustration of the broader concept, replacement of the MS2 stem-loops with PP7-interacting stem-loops may be used to bind/recruit repressive elements, enabling multiplexed bidirectional transcriptional control. Thus, in general, gRNA comprising a dead guide may be employed to provide for multiplex transcriptional control and preferred bidirectional transcriptional control. This transcriptional control is most preferred of genes. For example, one or more gRNA comprising dead guide(s) may be employed in targeting the activation of one or more target genes. At the same time, one or more gRNA comprising dead guide(s) may be employed in targeting the repression of one or more target genes. Such a sequence may be applied in a variety of different combinations, for example the target genes are first repressed and then at an appropriate period other targets are activated, or select genes are repressed at the same time as select genes are activated, followed by further activation and/or repression. As a result, multiple components of one or more biological systems may advantageously be addressed together.

In an aspect, the invention provides nucleic acid molecule(s) encoding dead gRNA or the Cpf1 CRISPR-Cas complex or the composition as described herein.

In an aspect, the invention provides a vector system comprising: a nucleic acid molecule encoding dead guide RNA as defined herein. In certain embodiments, the vector system further comprises a nucleic acid molecule(s) encoding Cpf1. In certain embodiments, the vector system further comprises a nucleic acid molecule(s) encoding (live) gRNA. In certain embodiments, the nucleic acid molecule or the vector further comprises regulatory element(s) operable in a eukaryotic cell operably linked to the nucleic acid molecule encoding the guide sequence (gRNA) and/or the nucleic acid molecule encoding Cpf1 and/or the optional nuclear localization sequence(s).

In another aspect, structural analysis may also be used to study interactions between the dead guide and the active Cpf1 nuclease that enable DNA binding, but no DNA cutting. In this way amino acids important for nuclease activity of Cpf1 are determined. Modification of such amino acids allows for improved Cpf1 enzymes used for gene editing.

A further aspect is combining the use of dead guides as explained herein with other applications of CRISPR, as explained herein as well as known in the art. For example, gRNA comprising dead guide(s) for targeted multiplex gene activation or repression or targeted multiplex bidirectional gene activation/repression may be combined with gRNA comprising guides which maintain nuclease activity, as explained herein. Such gRNA comprising guides which maintain nuclease activity may or may not further include modifications which allow for repression of gene activity (e.g. aptamers). Such gRNA comprising guides which maintain nuclease activity may or may not further include modifications which allow for activation of gene activity (e.g. aptamers). In such a manner, a further means for multiplex gene control is introduced (e.g. multiplex gene targeted activation without nuclease activity/without indel activity may be provided at the same time or in combination with gene targeted repression with nuclease activity).

For example, 1) using one or more gRNA (e.g. 1-50, 1-40, 1-30, 1-20, preferably 1-10, more preferably 1-5) comprising dead guide(s) targeted to one or more genes and further modified with appropriate aptamers for the recruitment of gene activators; 2) may be combined with one or more gRNA (e.g. 1-50, 1-40, 1-30, 1-20, preferably 1-10, more preferably 1-5) comprising dead guide(s) targeted to one or more genes and further modified with appropriate aptamers for the recruitment of gene repressors. 1) and/or 2) may then be combined with 3) one or more gRNA (e.g. 1-50, 1-40, 1-30, 1-20, preferably 1-10, more preferably 1-5) targeted to one or more genes. This combination can then be carried out in turn with 1)+2)+3) with 4) one or more gRNA (e.g. 1-50, 1-40, 1-30, 1-20, preferably 1-10, more preferably 1-5) targeted to one or more genes and further modified with appropriate aptamers for the recruitment of gene activators. This combination can then be carried in turn with 1)+2)+3)+4) with 5) one or more gRNA (e.g. 1-50, 1-40, 1-30, 1-20, preferably 1-10, more preferably 1-5) targeted to one or more genes and further modified with appropriate aptamers for the recruitment of gene repressors. As a result various uses and combinations are included in the invention. For example, combination 1)+2); combination 1)+3); combination 2)+3); combination 1)+2)+3); combination 1)+2)+3)+4); combination 1)+3)+4); combination 2)+3)+4); combination 1)+2)+4); combination 1)+2) +3)+4)+5); combination 1)+3)+4)+5); combination 2)+3)+4)+5); combination 1)+2)+4)+5); combination 1)+2)+3)+5); combination 1)+3)+5); combination 2)+3)+5); combination 1)+2)+5).

In an aspect, the invention provides an algorithm for designing, evaluating, or selecting a dead guide RNA targeting sequence (dead guide sequence) for guiding a Cpf1 CRISPR-Cas system to a target gene locus. In particular, it has been determined that dead guide RNA specificity relates to and can be optimized by varying i) GC content and ii) targeting sequence length. In an aspect, the invention provides an algorithm for designing or evaluating a dead guide RNA targeting sequence that minimizes off-target binding or interaction of the dead guide RNA. In an embodiment of the invention, the algorithm for selecting a dead guide RNA targeting sequence for directing a CRISPR system to a gene locus in an organism comprises a) locating one or more CRISPR motifs in the gene locus, analyzing the 20 nt sequence downstream of each CRISPR motif by i) determining the GC content of the sequence; and ii) determining whether there are off-target matches of the 15 downstream nucleotides nearest to the CRISPR motif in the genome of the organism, and c) selecting the 15 nucleotide sequence for use in a dead guide RNA if the GC content of the sequence is 70% or less and no off-target matches are identified. In an embodiment, the sequence is selected for a targeting sequence if the GC content is 60% or less. In certain embodiments, the sequence is selected for a targeting sequence if the GC content is 55% or less, 50% or less, 45% or less, 40% or less, 35% or less or 30% or less. In an embodiment, two or more sequences of the gene locus are analyzed and the sequence having the lowest GC content, or the next lowest GC content, or the next lowest GC content is selected. In an embodiment, the sequence is selected for a targeting sequence if no off-target matches are identified in the genome of the organism. In an embodiment, the targeting sequence is selected if no off-target matches are identified in regulatory sequences of the genome.

In an aspect, the invention provides a method of selecting a dead guide RNA targeting sequence for directing a functionalized CRISPR system to a gene locus in an organism, which comprises: a) locating one or more CRISPR motifs in the gene locus; b) analyzing the 20 nt sequence downstream of each CRISPR motif by: i) determining the GC content of the sequence; and ii) determining whether there are off-target matches of the first 15 nt of the sequence in the genome of the organism; c) selecting the sequence for use in a guide RNA if the GC content of the sequence is 70% or less and no off-target matches are identified. In an embodiment, the sequence is selected if the GC content is 50% or less. In an embodiment, the sequence is selected if the GC content is 40% or less. In an embodiment, the sequence is selected if the GC content is 30% or less. In an embodiment, two or more sequences are analyzed and the sequence having the lowest GC content is selected. In an embodiment, off-target matches are determined in regulatory sequences of the organism. In an embodiment, the gene locus is a regulatory region. An aspect provides a dead guide RNA comprising the targeting sequence selected according to the aforementioned methods.

In an aspect, the invention provides a dead guide RNA for targeting a functionalized CRISPR system to a gene locus in an organism. In an embodiment of the invention, the dead guide RNA comprises a targeting sequence wherein the CG content of the target sequence is 70% or less, and the first 15 nt of the targeting sequence does not match an off-target sequence downstream from a CRISPR motif in the regulatory sequence of another gene locus in the organism. In certain embodiments, the GC content of the targeting sequence 60% or less, 55% or less, 50% or less, 45% or less, 40% or less, 35% or less or 30% or less. In certain embodiments, the GC content of the targeting sequence is from 70% to 60% or from 60% to 50% or from 50% to 40% or from 40% to 30%. In an embodiment, the targeting sequence has the lowest CG content among potential targeting sequences of the locus.

In an embodiment of the invention, the first 15 nt of the dead guide match the target sequence. In another embodiment, first 14 nt of the dead guide match the target sequence. In another embodiment, the first 13 nt of the dead guide match the target sequence. In another embodiment first 12 nt of the dead guide match the target sequence. In another embodiment, first 11 nt of the dead guide match the target sequence. In another embodiment, the first 10 nt of the dead guide match the target sequence. In an embodiment of the invention the first 15 nt of the dead guide does not match an off-target sequence downstream from a CRISPR motif in the regulatory region of another gene locus. In other embodiments, the first 14 nt, or the first 13 nt of the dead guide, or the first 12 nt of the guide, or the first 11 nt of the dead guide, or the first 10 nt of the dead guide, does not match an off-target sequence downstream from a CRISPR motif in the regulatory region of another gene locus. In other embodiments, the first 15 nt, or 14 nt, or 13 nt, or 12 nt, or 11 nt of the dead guide do not match an off-target sequence downstream from a CRISPR motif in the genome.

In certain embodiments, the dead guide RNA includes additional nucleotides at the 3'-end that do not match the target sequence. Thus, a dead guide RNA that includes the first 15 nt, or 14 nt, or 13 nt, or 12 nt, or 11 nt downstream of a CRISPR motif can be extended in length at the 3' end to 12 nt, 13 nt, 14 nt, 15 nt, 16 nt, 17 nt, 18 nt, 19 nt, 20 nt, or longer.

The invention provides a method for directing a Cpf1 CRISPR-Cas system, including but not limited to a dead Cpf1 (dCpf1) or functionalized Cpf1 system (which may comprise a functionalized Cpf1 or functionalized guide) to a gene locus. In an aspect, the invention provides a method for selecting a dead guide RNA targeting sequence and directing a functionalized CRISPR system to a gene locus in an organism. In an aspect, the invention provides a method for selecting a dead guide RNA targeting sequence and effecting gene regulation of a target gene locus by a functionalized Cpf1 CRISPR-Cas system. In certain embodiments, the method is used to effect target gene regulation while minimizing off-target effects. In an aspect, the invention provides a method for selecting two or more dead guide RNA targeting sequences and effecting gene regulation of two or more target gene loci by a functionalized Cpf1 CRISPR-Cas system. In certain embodiments, the method is used to effect regulation of two or more target gene loci while minimizing off-target effects.

In an aspect, the invention provides a method of selecting a dead guide RNA targeting sequence for directing a functionalized Cpf1 to a gene locus in an organism, which comprises: a) locating one or more CRISPR motifs in the gene locus; b) analyzing the sequence downstream of each CRISPR motif by: i) selecting 10 to 15 nt adjacent to the CRISPR motif, ii) determining the GC content of the sequence; and c) selecting the 10 to 15 nt sequence as a targeting sequence for use in a guide RNA if the GC content of the sequence is 40% or more. In an embodiment, the sequence is selected if the GC content is 50% or more. In an embodiment, the sequence is selected if the GC content is 60% or more. In an embodiment, the sequence is selected if the GC content is 70% or more. In an embodiment, two or more sequences are analyzed and the sequence having the highest GC content is selected. In an embodiment, the method further comprises adding nucleotides to the 3' end of the selected sequence which do not match the sequence downstream of the CRISPR motif. An aspect provides a dead guide RNA comprising the targeting sequence selected according to the aforementioned methods.

In an aspect, the invention provides a dead guide RNA for directing a functionalized CRISPR system to a gene locus in an organism wherein the targeting sequence of the dead guide RNA consists of 10 to 15 nucleotides adjacent to the CRISPR motif of the gene locus, wherein the CG content of the target sequence is 50% or more. In certain embodiments, the dead guide RNA further comprises nucleotides added to the 3' end of the targeting sequence which do not match the sequence downstream of the CRISPR motif of the gene locus.

In an aspect, the invention provides for a single effector to be directed to one or more, or two or more gene loci. In certain embodiments, the effector is associated with a Cpf1, and one or more, or two or more selected dead guide RNAs are used to direct the Cpf1-associated effector to one or more, or two or more selected target gene loci. In certain embodiments, the effector is associated with one or more, or two or more selected dead guide RNAs, each selected dead guide RNA, when complexed with a Cpf1 enzyme, causing its associated effector to localize to the dead guide RNA target. One non-limiting example of such CRISPR systems modulates activity of one or more, or two or more gene loci subject to regulation by the same transcription factor.

In an aspect, the invention provides for two or more effectors to be directed to one or more gene loci. In certain embodiments, two or more dead guide RNAs are employed, each of the two or more effectors being associated with a selected dead guide RNA, with each of the two or more effectors being localized to the selected target of its dead guide RNA. One non-limiting example of such CRISPR systems modulates activity of one or more, or two or more gene loci subject to regulation by different transcription factors. Thus, in one non-limiting embodiment, two or more transcription factors are localized to different regulatory sequences of a single gene. In another non-limiting embodiment, two or more transcription factors are localized to different regulatory sequences of different genes. In certain embodiments, one transcription factor is an activator. In certain embodiments, one transcription factor is an inhibitor. In certain embodiments, one transcription factor is an activator and another transcription factor is an inhibitor. In certain embodiments, gene loci expressing different components of the same regulatory pathway are regulated. In certain embodiments, gene loci expressing components of different regulatory pathways are regulated.

In an aspect, the invention also provides a method and algorithm for designing and selecting dead guide RNAs that are specific for target DNA cleavage or target binding and gene regulation mediated by an active Cpf1 CRISPR-Cas system. In certain embodiments, the Cpf1 CRISPR-Cas system provides orthogonal gene control using an active Cpf1 which cleaves target DNA at one gene locus while at the same time binds to and promotes regulation of another gene locus.

In an aspect, the invention provides an method of selecting a dead guide RNA targeting sequence for directing a functionalized Cpf1 to a gene locus in an organism, without cleavage, which comprises a) locating one or more CRISPR motifs in the gene locus; b) analyzing the sequence downstream of each CRISPR motif by i) selecting 10 to 15 nt adjacent to the CRISPR motif, ii) determining the GC content of the sequence, and c) selecting the 10 to 15 nt sequence as a targeting sequence for use in a dead guide RNA if the GC content of the sequence is 30% more, 40% or more. In certain embodiments, the GC content of the targeting sequence is 35% or more, 40% or more, 45% or more, 50% or more, 55% or more, 60% or more, 65% or more, or 70% or more. In certain embodiments, the GC content of the targeting sequence is from 30% to 40% or from 40% to 50% or from 50% to 60% or from 60% to 70%. In an embodiment of the invention, two or more sequences in a gene locus are analyzed and the sequence having the highest GC content is selected.

In an embodiment of the invention, the portion of the targeting sequence in which GC content is evaluated is 10 to 15 contiguous nucleotides of the 15 target nucleotides nearest to the PAM. In an embodiment of the invention, the portion of the guide in which GC content is considered is the 10 to 11 nucleotides or 11 to 12 nucleotides or 12 to 13 nucleotides or 13, or 14, or 15 contiguous nucleotides of the 15 nucleotides nearest to the PAM.

In an aspect, the invention further provides an algorithm for identifying dead guide RNAs which promote CRISPR system gene locus cleavage while avoiding functional activation or inhibition. It is observed that increased GC content in dead guide RNAs of 16 to 20 nucleotides coincides with increased DNA cleavage and reduced functional activation.

It is also demonstrated herein that efficiency of functionalized Cpf1 can be increased by addition of nucleotides to the 3' end of a guide RNA which do not match a target sequence downstream of the CRISPR motif. For example, of dead guide RNA 11 to 15 nt in length, shorter guides may be less likely to promote target cleavage, but are also less efficient at promoting CRISPR system binding and functional control. In certain embodiments, addition of nucleotides that don't match the target sequence to the 3' end of the dead guide RNA increase activation efficiency while not increasing undesired target cleavage. In an aspect, the invention also provides a method and algorithm for identifying improved dead guide RNAs that effectively promote CRISPRP system function in DNA binding and gene regulation while not promoting DNA cleavage. Thus, in certain embodiments, the invention provides a dead guide RNA that includes the first 15 nt, or 14 nt, or 13 nt, or 12 nt, or 11 nt downstream of a CRISPR motif and is extended in length at the 3' end by nucleotides that mismatch the target to 12 nt, 13 nt, 14 nt, 15 nt, 16 nt, 17 nt, 18 nt, 19 nt, 20 nt, or longer.

In an aspect, the invention provides a method for effecting selective orthogonal gene control. As will be appreciated from the disclosure herein, dead guide selection according to the invention, taking into account guide length and GC content, provides effective and selective transcription control by a functional Cpf1 CRISPR-Cas system, for example to regulate transcription of a gene locus by activation or inhibition and minimize off-target effects. Accordingly, by providing effective regulation of individual target loci, the invention also provides effective orthogonal regulation of two or more target loci.

In certain embodiments, orthogonal gene control is by activation or inhibition of two or more target loci. In certain embodiments, orthogonal gene control is by activation or inhibition of one or more target locus and cleavage of one or more target locus.

In one aspect, the invention provides a cell comprising a non-naturally occurring Cpf1 CRISPR-Cas system comprising one or more dead guide RNAs disclosed or made according to a method or algorithm described herein wherein the expression of one or more gene products has been altered. In an embodiment of the invention, the expression in the cell of two or more gene products has been altered. The invention also provides a cell line from such a cell.

In one aspect, the invention provides a multicellular organism comprising one or more cells comprising a non-naturally occurring Cpf1 CRISPR-Cas system comprising one or more dead guide RNAs disclosed or made according to a method or algorithm described herein. In one aspect, the invention provides a product from a cell, cell line, or multicellular organism comprising a non-naturally occurring Cpf1 CRISPR-Cas system comprising one or more dead guide RNAs disclosed or made according to a method or algorithm described herein.

A further aspect of this invention is the use of gRNA comprising dead guide(s) as described herein, optionally in combination with gRNA comprising guide(s) as described herein or in the state of the art, in combination with systems e.g. cells, transgenic animals, transgenic mice, inducible transgenic animals, inducible transgenic mice) which are engineered for either overexpression of Cpf1 or preferably knock in Cpf1. As a result a single system (e.g. transgenic animal, cell) can serve as a basis for multiplex gene modifications in systems/network biology. On account of the dead guides, this is now possible in both in vitro, ex vivo, and in vivo.

For example, once the Cpf1 is provided for, one or more dead gRNAs may be provided to direct multiplex gene regulation, and preferably multiplex bidirectional gene regulation. The one or more dead gRNAs may be provided in a spatially and temporally appropriate manner if necessary or desired (for example tissue specific induction of Cpf1 expression). On account that the transgenic/inducible Cpf1 is provided for (e.g. expressed) in the cell, tissue, animal of interest, both gRNAs comprising dead guides or gRNAs comprising guides are equally effective. In the same manner, a further aspect of this invention is the use of gRNA comprising dead guide(s) as described herein, optionally in combination with gRNA comprising guide(s) as described herein or in the state of the art, in combination with systems (e.g. cells, transgenic animals, transgenic mice, inducible transgenic animals, inducible transgenic mice) which are engineered for knockout Cpf1 CRISPR-Cas.

As a result, the combination of dead guides as described herein with CRISPR applications described herein and CRISPR applications known in the art results in a highly efficient and accurate means for multiplex screening of systems (e.g. network biology). Such screening allows, for example, identification of specific combinations of gene activities for identifying genes responsible for diseases (e.g. on/off combinations), in particular gene related diseases. A preferred application of such screening is cancer. In the same manner, screening for treatment for such diseases is included in the invention. Cells or animals may be exposed to aberrant conditions resulting in disease or disease like effects. Candidate compositions may be provided and screened for an effect in the desired multiplex environment. For example a patient's cancer cells may be screened for which gene combinations will cause them to die, and then use this information to establish appropriate therapies.

The structural information provided herein allows for interrogation of dead gRNA interaction with the target DNA and the Cpf1 permitting engineering or alteration of dead gRNA structure to optimize functionality of the entire Cpf1 CRISPR-Cas system. For example, loops of the dead gRNA may be extended, without colliding with the Cpf1 protein by the insertion of adaptor proteins that can bind to RNA. These adaptor proteins can further recruit effector proteins or fusions which comprise one or more functional domains.

In some preferred embodiments, the functional domain is a transcriptional activation domain, preferably VP64. In some embodiments, the functional domain is a transcription repression domain, preferably KRAB. In some embodiments, the transcription repression domain is SID, or concatemers of SID (e.g. SID4X). In some embodiments, the functional domain is an epigenetic modifying domain, such that an epigenetic modifying enzyme is provided. In some embodiments, the functional domain is an activation domain, which may be the P65 activation domain.

An aspect of the invention is that the above elements are comprised in a single composition or comprised in individual compositions. These compositions may advantageously be applied to a host to elicit a functional effect on the genomic level.

In general, the dead gRNA are modified in a manner that provides specific binding sites (e.g. aptamers) for adapter proteins comprising one or more functional domains (e.g. via fusion protein) to bind to. The modified dead gRNA are modified such that once the dead gRNA forms a CRISPR complex (i.e. Cpf1 binding to dead gRNA and target) the adapter proteins bind and, the functional domain on the adapter protein is positioned in a spatial orientation which is advantageous for the attributed function to be effective. For example, if the functional domain is a transcription activator (e.g. VP64 or p65), the transcription activator is placed in a spatial orientation which allows it to affect the transcription of the target. Likewise, a transcription repressor will be advantageously positioned to affect the transcription of the target and a nuclease (e.g. Fok1) will be advantageously positioned to cleave or partially cleave the target.

The skilled person will understand that modifications to the dead gRNA which allow for binding of the adapter+ functional domain but not proper positioning of the adapter+ functional domain (e.g. due to steric hindrance within the three dimensional structure of the CRISPR complex) are modifications which are not intended. The one or more modified dead gRNA may be modified at the tetra loop, the stem loop 1, stem loop 2, or stem loop 3, as described herein, preferably at either the tetra loop or stem loop 2, and most preferably at both the tetra loop and stem loop 2.

As explained herein the functional domains may be, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). In some cases it is advantageous that additionally at least one NLS is provided. In some instances, it is advantageous to position the NLS at the N terminus. When more than one functional domain is included, the functional domains may be the same or different.

The dead gRNA may be designed to include multiple binding recognition sites (e.g. aptamers) specific to the same or different adapter protein. The dead gRNA may be designed to bind to the promoter region −1000-+1 nucleic acids upstream of the transcription start site (i.e. TSS), preferably −200 nucleic acids. This positioning improves functional domains which affect gene activation (e.g. transcription activators) or gene inhibition (e.g. transcription repressors). The modified dead gRNA may be one or more modified dead gRNAs targeted to one or more target loci (e.g. at least 1 gRNA, at least 2 gRNA, at least 5 gRNA, at least 10 gRNA, at least 20 gRNA, at least 30 gRNA, at least 50 gRNA) comprised in a composition.

The adaptor protein may be any number of proteins that binds to an aptamer or recognition site introduced into the modified dead gRNA and which allows proper positioning of one or more functional domains, once the dead gRNA has been incorporated into the CRISPR complex, to affect the target with the attributed function. As explained in detail in this application such may be coat proteins, preferably bacteriophage coat proteins. The functional domains associated with such adaptor proteins (e.g. in the form of fusion protein) may include, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). Preferred domains are Fok1, VP64, P65, HSF1, MyoD1. In the event that the functional domain is a transcription activator or transcription repressor it is advantageous that additionally at least an NLS is provided and preferably at the N terminus. When more than one functional domain is included, the functional domains may be the same or different. The adaptor protein may utilize known linkers to attach such functional domains.

In another aspect the dead guides are further modified to improve specificity. Protected dead guides may be synthesized, whereby secondary structure is introduced into the 3' end of the dead guide to improve its specificity. A protected guide RNA (pgRNA) comprises a guide sequence capable of hybridizing to a target sequence in a genomic locus of interest in a cell and a protector strand, wherein the protector strand is optionally complementary to the guide sequence and wherein the guide sequence may in part be hybridizable to the protector strand. The pgRNA optionally includes an extension sequence. The thermodynamics of the pgRNA-target DNA hybridization is determined by the number of bases complementary between the guide RNA and target DNA. By employing 'thermodynamic protection', specificity of dead gRNA can be improved by adding a protector sequence. For example, one method adds a complementary protector strand of varying lengths to the 3' end of the guide sequence within the dead gRNA. As a result, the protector strand is bound to at least a portion of the dead gRNA and provides for a protected gRNA (pgRNA). In turn, the dead gRNA references herein may be easily protected using the described embodiments, resulting in pgRNA. The protector strand can be either a separate RNA transcript or strand or a chimeric version joined to the 3' end of the dead gRNA guide sequence.

Escorted Guides for the Cpf1 CRISPR-Cas System According to the Invention

In one aspect the invention provides escorted Cpf1 CRISPR-Cas systems or complexes, especially such a system involving an escorted Cpf1 CRISPR-Cas system guide. By "escorted" is meant that the Cpf1 CRISPR-Cas system or complex or guide is delivered to a selected time or place within a cell, so that activity of the Cpf1 CRISPR-Cas system or complex or guide is spatially or temporally controlled. For example, the activity and destination of the Cpf1 CRISPR-Cas system or complex or guide may be controlled by an escort RNA aptamer sequence that has binding affinity for an aptamer ligand, such as a cell surface protein or other localized cellular component. Alternatively, the escort aptamer may for example be responsive to an aptamer effector on or in the cell, such as a transient effector, such as an external energy source that is applied to the cell at a particular time.

The escorted Cpf1 CRISPR-Cas systems or complexes have a gRNA with a functional structure designed to improve gRNA structure, architecture, stability, genetic expression, or any combination thereof. Such a structure can include an aptamer.

Aptamers are biomolecules that can be designed or selected to bind tightly to other ligands, for example using a technique called systematic evolution of ligands by exponential enrichment (SELEX; Tuerk C, Gold L: "Systematic evolution of ligands by exponential enrichment: RNA ligands to bacteriophage T4 DNA polymerase." Science 1990, 249:505-510). Nucleic acid aptamers can for example be selected from pools of random-sequence oligonucleotides, with high binding affinities and specificities for a wide range of biomedically relevant targets, suggesting a wide range of therapeutic utilities for aptamers (Keefe, Anthony D., Supriya Pai, and Andrew Ellington. "Aptamers as therapeutics." Nature Reviews Drug Discovery 9.7 (2010): 537-550). These characteristics also suggest a wide range of uses for aptamers as drug delivery vehicles (Levy-Nissenbaum, Etgar, et al. "Nanotechnology and aptamers: applications in drug delivery." Trends in biotechnology 26.8 (2008): 442-449; and, Hicke B J, Stephens A W. "Escort aptamers: a delivery service for diagnosis and therapy." J Clin Invest 2000, 106:923-928.). Aptamers may also be constructed that function as molecular switches, responding to a que by changing properties, such as RNA aptamers that bind fluorophores to mimic the activity of green flourescent protein (Paige, Jeremy S., Karen Y. Wu, and Samie R. Jaffrey. "RNA mimics of green fluorescent protein." Science 333.6042 (2011): 642-646). It has also been suggested that aptamers may be used as components of targeted siRNA therapeutic delivery systems, for example targeting cell surface proteins (Zhou, Jiehua, and John J. Rossi. "Aptamer-targeted cell-specific RNA interference." Silence 1.1 (2010): 4).

Accordingly, provided herein is a gRNA modified, e.g., by one or more aptamer(s) designed to improve gRNA delivery, including delivery across the cellular membrane, to intracellular compartments, or into the nucleus. Such a structure can include, either in addition to the one or more aptamer(s) or without such one or more aptamer(s), moiety(ies) so as to render the guide deliverable, inducible or responsive to a selected effector. The invention accordingly comprehends an gRNA that responds to normal or pathological physiological conditions, including without limitation pH, hypoxia, O2 concentration, temperature, protein concentration, enzymatic concentration, lipid structure, light exposure, mechanical disruption (e.g. ultrasound waves), magnetic fields, electric fields, or electromagnetic radiation.

An aspect of the invention provides non-naturally occurring or engineered composition comprising an escorted guide RNA (egRNA) comprising:
an RNA guide sequence capable of hybridizing to a target sequence in a genomic locus of interest in a cell; and,
an escort RNA aptamer sequence, wherein the escort aptamer has binding affinity for an aptamer ligand on or in the cell, or the escort aptamer is responsive to a localized aptamer effector on or in the cell, wherein the presence of the aptamer ligand or effector on or in the cell is spatially or temporally restricted.

The escort aptamer may for example change conformation in response to an interaction with the aptamer ligand or effector in the cell.

The escort aptamer may have specific binding affinity for the aptamer ligand.

The aptamer ligand may be localized in a location or compartment of the cell, for example on or in a membrane of the cell. Binding of the escort aptamer to the aptamer ligand may accordingly direct the egRNA to a location of interest in the cell, such as the interior of the cell by way of binding to an aptamer ligand that is a cell surface ligand. In this way, a variety of spatially restricted locations within the cell may be targeted, such as the cell nucleus or mitochondria.

Once intended alterations have been introduced, such as by editing intended copies of a gene in the genome of a cell, continued CRISRP/Cpf1 expression in that cell is no longer necessary. Indeed, sustained expression would be undesirable in certain casein case of off-target effects at unintended genomic sites, etc. Thus time-limited expression would be useful. Inducible expression offers one approach, but in addition Applicants have engineered a Self-Inactivating Cpf1 CRISPR-Cas system that relies on the use of a non-coding guide target sequence within the CRISPR vector itself. Thus, after expression begins, the CRISPR system will lead to its own destruction, but before destruction is complete it will have time to edit the genomic copies of the target gene (which, with a normal point mutation in a diploid cell, requires at most two edits). Simply, the self inactivating Cpf1 CRISPR-Cas system includes additional RNA (i.e., guide RNA) that targets the coding sequence for the CRISPR enzyme itself or that targets one or more non-coding guide target sequences complementary to unique sequences present in one or more of the following: (a) within the promoter driving expression of the non-coding RNA elements, (b) within the promoter driving expression of the Cpf1 gene, (c) within 100 bp of the ATG translational start codon in the Cpf1 coding sequence, (d) within the inverted terminal repeat (iTR) of a viral delivery vector, e.g., in an AAV genome.

The egRNA may include an RNA aptamer linking sequence, operably linking the escort RNA sequence to the RNA guide sequence.

In embodiments, the egRNA may include one or more photolabile bonds or non-naturally occurring residues.

In one aspect, the escort RNA aptamer sequence may be complementary to a target miRNA, which may or may not be present within a cell, so that only when the target miRNA is present is there binding of the escort RNA aptamer sequence to the target miRNA which results in cleavage of the egRNA by an RNA-induced silencing complex (RISC) within the cell.

In embodiments, the escort RNA aptamer sequence may for example be from 10 to 200 nucleotides in length, and the egRNA may include more than one escort RNA aptamer sequence. It is to be understood that any of the RNA guide sequences as described herein elsewhere can be used in the egRNA described herein. In certain embodiments of the invention, the guide RNA or mature crRNA comprises, consists essentially of, or consists of a direct repeat sequence and a guide sequence or spacer sequence. In certain embodiments, the guide RNA or mature crRNA comprises, consists essentially of, or consists of a direct repeat sequence linked to a guide sequence or spacer sequence. In certain embodiments the guide RNA or mature crRNA comprises 19 nts of partial direct repeat followed by 23-25 nt of guide sequence or spacer sequence. In certain embodiments, the effector protein is a FnCpf1 effector protein and requires at least 16 nt of guide sequence to achieve detectable DNA cleavage and a minimum of 17 nt of guide sequence to achieve efficient DNA cleavage in vitro. In certain embodiments, the direct repeat sequence is located upstream (i.e., 5') from the guide sequence or spacer sequence. In a preferred embodiment the seed sequence (i.e. the sequence essential critical for recognition and/or hybridization to the sequence at the target locus) of the FnCpf1 guide RNA is approximately within the first 5 nt on the 5' end of the guide sequence or spacer sequence.

The egRNA may be included in a non-naturally occurring or engineered Cpf1 CRISPR-Cas complex composition, together with a Cpf1 which may include at least one mutation, for example a mutation so that the Cpf1 has no more than 5% of the nuclease activity of a Cpf1 not having the at least one mutation, for example having a diminished nuclease activity of at least 97%, or 100% as compared with the Cpf1 not having the at least one mutation. The Cpf1 may also include one or more nuclear localization sequences. Mutated Cpf1 enzymes having modulated such as diminished nuclease activity are described herein elsewhere.

The engineered Cpf1 CRISPR-Cas composition may be provided in a cell, such as a eukaryotic cell, a mammalian cell, or a human cell.

In embodiments, the compositions described herein comprise a Cpf1 CRISPR-Cas complex having at least three functional domains, at least one of which is associated with Cpf1 and at least two of which are associated with egRNA.

The present invention provides compositions and methods by which gRNA-mediated gene editing activity can be adapted. The invention provides gRNA secondary structures that improve cutting efficiency by increasing gRNA and/or increasing the amount of RNA delivered into the cell. The gRNA may include light labile or inducible nucleotides.

To increase the effectiveness of gRNA, for example gRNA delivered with viral or non-viral technologies, Applicants added secondary structures into the gRNA that enhance its stability and improve gene editing. Separately, to overcome the lack of effective delivery, Applicants modified gRNAs with cell penetrating RNA aptamers; the aptamers bind to cell surface receptors and promote the entry of gRNAs into cells. Notably, the cell-penetrating aptamers can be designed to target specific cell receptors, in order to mediate cell-specific delivery. Applicants also have created guides that are inducible.

Light responsiveness of an inducible system may be achieved via the activation and binding of cryptochrome-2 and CIB1. Blue light stimulation induces an activating conformational change in cryptochrome-2, resulting in recruitment of its binding partner CIB1. This binding is fast and reversible, achieving saturation in <15 sec following pulsed stimulation and returning to baseline <15 min after the end of stimulation. These rapid binding kinetics result in a system temporally bound only by the speed of transcription/translation and transcript/protein degradation, rather than uptake and clearance of inducing agents. Cryptochrome-2 activation is also highly sensitive, allowing for the use of low light intensity stimulation and mitigating the risks of phototoxicity. Further, in a context such as the intact mammalian brain, variable light intensity may be used to control the size of a stimulated region, allowing for greater precision than vector delivery alone may offer.

The invention contemplates energy sources such as electromagnetic radiation, sound energy or thermal energy to induce the guide. Advantageously, the electromagnetic radiation is a component of visible light. In a preferred embodiment, the light is a blue light with a wavelength of about 450 to about 495 nm. In an especially preferred embodiment, the wavelength is about 488 nm. In another preferred embodiment, the light stimulation is via pulses. The light power may range from about 0-9 mW/cm2. In a preferred embodiment, a stimulation paradigm of as low as 0.25 sec every 15 sec should result in maximal activation.

Cells involved in the practice of the present invention may be a prokaryotic cell or a eukaryotic cell, advantageously an animal cell a plant cell or a yeast cell, more advantageously a mammalian cell.

The chemical or energy sensitive guide may undergo a conformational change upon induction by the binding of a chemical source or by the energy allowing it act as a guide and have the Cpf1 CRISPR-Cas system or complex function. The invention can involve applying the chemical source or energy so as to have the guide function and the Cpf1 CRISPR-Cas system or complex function; and optionally further determining that the expression of the genomic locus is altered. There are several different designs of this chemical inducible system: 1. ABI-PYL based system inducible by Abscisic Acid (ABA) (see, e.g., stke.sciencemag.org/cgi/content/abstract/sigtrans; 4/164/rs2), 2. FKBP-FRB based system inducible by rapamycin (or related chemicals based on rapamycin) (see, e.g., worldwideweb.nature.com/nmeth/journal/v2/n6/full/nmeth763.html), 3. GID1-GAI based system inducible by Gibberellin (GA) (see, e.g., worldwideweb.nature.com/nchembio/journal/v8/n5/full/nchembio.922.html).

Another system contemplated by the present invention is a chemical inducible system based on change in sub-cellular localization. Applicants also developed a system in which the polypeptide include a DNA binding domain comprising at least five or more Transcription activator-like effector (TALE) monomers and at least one or more half-monomers specifically ordered to target the genomic locus of interest linked to at least one or more effector domains are further linker to a chemical or energy sensitive protein. This protein will lead to a change in the sub-cellular localization of the entire polypeptide (i.e. transportation of the entire polypeptide from cytoplasm into the nucleus of the cells) upon the binding of a chemical or energy transfer to the chemical or energy sensitive protein. This transportation of the entire polypeptide from one sub-cellular compartments or organelles, in which its activity is sequestered due to lack of substrate for the effector domain, into another one in which the substrate is present would allow the entire polypeptide to come in contact with its desired substrate (i.e. genomic DNA in the mammalian nucleus) and result in activation or repression of target gene expression.

This type of system could also be used to induce the cleavage of a genomic locus of interest in a cell when the effector domain is a nuclease.

A chemical inducible system can be an estrogen receptor (ER) based system inducible by 4-hydroxytamoxifen (4OHT) (see, e.g., worldwideweb.pnas.org/content/104/3/1027.abstract). A mutated ligand-binding domain of the estrogen receptor called ERT2 translocates into the nucleus of cells upon binding of 4-hydroxytamoxifen. In further embodiments of the invention any naturally occurring or engineered derivative of any nuclear receptor, thyroid hormone receptor, retinoic acid receptor, estrogren receptor, estrogen-related receptor, glucocorticoid receptor, progesterone receptor, androgen receptor may be used in inducible systems analogous to the ER based inducible system.

Another inducible system is based on the design using Transient receptor potential (TRP) ion channel based system inducible by energy, heat or radio-wave (see, e.g., worldwideweb.sciencemag.org/content/336/6081/604). These TRP family proteins respond to different stimuli, including light and heat. When this protein is activated by light or heat, the ion channel will open and allow the entering of ions such as calcium into the plasma membrane. This influx of ions will bind to intracellular ion interacting partners linked to a polypeptide including the guide and the other components of the Cpf1 CRISPR-Cas complex or system, and the binding will induce the change of sub-cellular localization of the polypeptide, leading to the entire polypeptide entering the nucleus of cells. Once inside the nucleus, the guide protein and the other components of the Cpf1 CRISPR-Cas complex will be active and modulating target gene expression in cells.

This type of system could also be used to induce the cleavage of a genomic locus of interest in a cell; and, in this regard, it is noted that the Cpf1 enzyme is a nuclease. The light could be generated with a laser or other forms of energy sources. The heat could be generated by raise of temperature results from an energy source, or from nano-particles that release heat after absorbing energy from an energy source delivered in the form of radio-wave.

While light activation may be an advantageous embodiment, sometimes it may be disadvantageous especially for in vivo applications in which the light may not penetrate the skin or other organs. In this instance, other methods of energy activation are contemplated, in particular, electric field energy and/or ultrasound which have a similar effect.

Electric field energy is preferably administered substantially as described in the art, using one or more electric pulses of from about 1 Volt/cm to about 10 kVolts/cm under in vivo conditions. Instead of or in addition to the pulses, the electric field may be delivered in a continuous manner. The electric pulse may be applied for between 1 μs and 500 milliseconds, preferably between 1 μs and 100 milliseconds. The electric field may be applied continuously or in a pulsed manner for 5 about minutes.

As used herein, 'electric field energy' is the electrical energy to which a cell is exposed. Preferably the electric field has a strength of from about 1 Volt/cm to about 10 kVolts/cm or more under in vivo conditions (see WO97/49450).

As used herein, the term "electric field" includes one or more pulses at variable capacitance and voltage and including exponential and/or square wave and/or modulated wave and/or modulated square wave forms. References to electric fields and electricity should be taken to include reference the presence of an electric potential difference in the environment of a cell. Such an environment may be set up by way of static electricity, alternating current (AC), direct current (DC), etc, as known in the art. The electric field may be uniform, non-uniform or otherwise, and may vary in strength and/or direction in a time dependent manner.

Single or multiple applications of electric field, as well as single or multiple applications of ultrasound are also possible, in any order and in any combination. The ultrasound and/or the electric field may be delivered as single or multiple continuous applications, or as pulses (pulsatile delivery).

Electroporation has been used in both in vitro and in vivo procedures to introduce foreign material into living cells. With in vitro applications, a sample of live cells is first mixed with the agent of interest and placed between electrodes such as parallel plates. Then, the electrodes apply an electrical field to the cell/implant mixture. Examples of systems that perform in vitro electroporation include the Electro Cell Manipulator ECM600 product, and the Electro Square Porator T820, both made by the BTX Division of Genetronics, Inc (see U.S. Pat. No. 5,869,326). The known electroporation techniques (both in vitro and in vivo) function by applying a brief high voltage pulse to electrodes positioned around the treatment region. The electric field generated between the electrodes causes the cell membranes to temporarily become porous, whereupon molecules of the agent of interest enter the cells. In known electroporation applications, this electric field comprises a single square wave pulse on the order of 1000 V/cm, of about 100 .mu.s duration. Such a pulse may be generated, for example, in known applications of the Electro Square Porator T820.

Preferably, the electric field has a strength of from about 1 V/cm to about 10 kV/cm under in vitro conditions. Thus, the electric field may have a strength of 1 V/cm, 2 V/cm, 3 V/cm, 4 V/cm, 5 V/cm, 6 V/cm, 7 V/cm, 8 V/cm, 9 V/cm, 10 V/cm, 20 V/cm, 50 V/cm, 100 V/cm, 200 V/cm, 300 V/cm, 400 V/cm, 500 V/cm, 600 V/cm, 700 V/cm, 800 V/cm, 900 V/cm, 1 kV/cm, 2 kV/cm, 5 kV/cm, 10 kV/cm, 20 kV/cm, 50 kV/cm or more. More preferably from about 0.5 kV/cm to about 4.0 kV/cm under in vitro conditions. Preferably the electric field has a strength of from about 1 V/cm to about 10 kV/cm under in vivo conditions. However, the electric field strengths may be lowered where the number of pulses delivered to the target site are increased. Thus, pulsatile delivery of electric fields at lower field strengths is envisaged.

Preferably the application of the electric field is in the form of multiple pulses such as double pulses of the same strength and capacitance or sequential pulses of varying strength and/or capacitance. As used herein, the term "pulse" includes one or more electric pulses at variable capacitance and voltage and including exponential and/or square wave and/or modulated wave/square wave forms.

Preferably the electric pulse is delivered as a waveform selected from an exponential wave form, a square wave form, a modulated wave form and a modulated square wave form.

A preferred embodiment employs direct current at low voltage. Thus, Applicants disclose the use of an electric field which is applied to the cell, tissue or tissue mass at a field strength of between 1V/cm and 20V/cm, for a period of 100 milliseconds or more, preferably 15 minutes or more.

Ultrasound is advantageously administered at a power level of from about 0.05 W/cm2 to about 100 W/cm2. Diagnostic or therapeutic ultrasound may be used, or combinations thereof.

As used herein, the term "ultrasound" refers to a form of energy which consists of mechanical vibrations the frequencies of which are so high they are above the range of human hearing. Lower frequency limit of the ultrasonic spectrum may generally be taken as about 20 kHz. Most diagnostic applications of ultrasound employ frequencies in the range 1 and 15 MHz' (From Ultrasonics in Clinical Diagnosis, P. N. T. Wells, ed., 2nd. Edition, Publ. Churchill Livingstone [Edinburgh, London & NY, 1977]).

Ultrasound has been used in both diagnostic and therapeutic applications. When used as a diagnostic tool ("diagnostic ultrasound"), ultrasound is typically used in an energy density range of up to about 100 mW/cm2 (FDA recommendation), although energy densities of up to 750 mW/cm2 have been used. In physiotherapy, ultrasound is typically used as an energy source in a range up to about 3 to 4 W/cm2 (WHO recommendation). In other therapeutic applications, higher intensities of ultrasound may be employed, for example, HIFU at 100 W/cm up to 1 kW/cm2 (or even higher) for short periods of time. The term "ultrasound" as used in this specification is intended to encompass diagnostic, therapeutic and focused ultrasound.

Focused ultrasound (FUS) allows thermal energy to be delivered without an invasive probe (see Morocz et al 1998 Journal of Magnetic Resonance Imaging Vol. 8, No. 1, pp. 136-142. Another form of focused ultrasound is high intensity focused ultrasound (HIFU) which is reviewed by Moussatov et al in Ultrasonics (1998) Vol. 36, No. 8, pp. 893-900 and TranHuuHue et al in Acustica (1997) Vol. 83, No. 6, pp. 1103-1106.

Preferably, a combination of diagnostic ultrasound and a therapeutic ultrasound is employed. This combination is not intended to be limiting, however, and the skilled reader will appreciate that any variety of combinations of ultrasound may be used. Additionally, the energy density, frequency of ultrasound, and period of exposure may be varied.

Preferably the exposure to an ultrasound energy source is at a power density of from about 0.05 to about 100 Wcm-2. Even more preferably, the exposure to an ultrasound energy source is at a power density of from about 1 to about 15 Wcm-2.

Preferably the exposure to an ultrasound energy source is at a frequency of from about 0.015 to about 10.0 MHz. More preferably the exposure to an ultrasound energy source is at a frequency of from about 0.02 to about 5.0 MHz or about 6.0 MHz. Most preferably, the ultrasound is applied at a frequency of 3 MHz.

Preferably the exposure is for periods of from about 10 milliseconds to about 60 minutes. Preferably the exposure is for periods of from about 1 second to about 5 minutes. More preferably, the ultrasound is applied for about 2 minutes. Depending on the particular target cell to be disrupted, however, the exposure may be for a longer duration, for example, for 15 minutes.

Advantageously, the target tissue is exposed to an ultrasound energy source at an acoustic power density of from about 0.05 Wcm-2 to about 10 Wcm-2 with a frequency ranging from about 0.015 to about 10 MHz (see WO 98/52609). However, alternatives are also possible, for example, exposure to an ultrasound energy source at an acoustic power density of above 100 Wcm-2, but for reduced periods of time, for example, 1000 Wcm-2 for periods in the millisecond range or less.

Preferably the application of the ultrasound is in the form of multiple pulses; thus, both continuous wave and pulsed wave (pulsatile delivery of ultrasound) may be employed in any combination. For example, continuous wave ultrasound may be applied, followed by pulsed wave ultrasound, or vice versa. This may be repeated any number of times, in any order and combination. The pulsed wave ultrasound may be applied against a background of continuous wave ultrasound, and any number of pulses may be used in any number of groups.

Preferably, the ultrasound may comprise pulsed wave ultrasound. In a highly preferred embodiment, the ultrasound is applied at a power density of 0.7 Wcm-2 or 1.25 Wcm-2 as a continuous wave. Higher power densities may be employed if pulsed wave ultrasound is used.

Use of ultrasound is advantageous as, like light, it may be focused accurately on a target. Moreover, ultrasound is advantageous as it may be focused more deeply into tissues unlike light. It is therefore better suited to whole-tissue penetration (such as but not limited to a lobe of the liver) or whole organ (such as but not limited to the entire liver or an entire muscle, such as the heart) therapy. Another important advantage is that ultrasound is a non-invasive stimulus which is used in a wide variety of diagnostic and therapeutic applications. By way of example, ultrasound is well known in medical imaging techniques and, additionally, in orthopedic therapy. Furthermore, instruments suitable for the application of ultrasound to a subject vertebrate are widely available and their use is well known in the art.

The rapid transcriptional response and endogenous targeting of the instant invention make for an ideal system for the study of transcriptional dynamics. For example, the instant invention may be used to study the dynamics of variant production upon induced expression of a target gene. On the other end of the transcription cycle, mRNA degradation studies are often performed in response to a strong extracellular stimulus, causing expression level changes in a plethora of genes. The instant invention may be utilized to reversibly induce transcription of an endogenous target, after which point stimulation may be stopped and the degradation kinetics of the unique target may be tracked.

The temporal precision of the instant invention may provide the power to time genetic regulation in concert with experimental interventions. For example, targets with suspected involvement in long-term potentiation (LTP) may be modulated in organotypic or dissociated neuronal cultures, but only during stimulus to induce LTP, so as to avoid interfering with the normal development of the cells. Similarly, in cellular models exhibiting disease phenotypes, targets suspected to be involved in the effectiveness of a particular therapy may be modulated only during treatment. Conversely, genetic targets may be modulated only during a pathological stimulus. Any number of experiments in which timing of genetic cues to external experimental stimuli is of relevance may potentially benefit from the utility of the instant invention.

The in vivo context offers equally rich opportunities for the instant invention to control gene expression. Photoinducibility provides the potential for spatial precision. Taking advantage of the development of optrode technology, a stimulating fiber optic lead may be placed in a precise brain region. Stimulation region size may then be tuned by light intensity. This may be done in conjunction with the delivery of the Cpf1 CRISPR-Cas system or complex of the invention, or, in the case of transgenic Cpf1 animals, guide RNA of the invention may be delivered and the optrode technology can allow for the modulation of gene expression in precise brain regions. A transparent Cpf1 expressing organism, can have guide RNA of the invention administered to it and then there can be extremely precise laser induced local gene expression changes.

A culture medium for culturing host cells includes a medium commonly used for tissue culture, such as M199-earle base, Eagle MEM (E-MEM), Dulbecco MEM (DMEM), SC-UCM102, UP-SFM (GIBCO BRL), EX-CELL302 (Nichirei), EX-CELL293-S(Nichirei), TFBM-01 (Nichirei), ASF104, among others. Suitable culture media for specific cell types may be found at the American Type Culture Collection (ATCC) or the European Collection of Cell Cultures (ECACC). Culture media may be supplemented with amino acids such as L-glutamine, salts, anti-fungal or anti-bacterial agents such as Fungizone®, penicillin-streptomycin, animal serum, and the like. The cell culture medium may optionally be serum-free.

The invention may also offer valuable temporal precision in vivo. The invention may be used to alter gene expression during a particular stage of development. The invention may be used to time a genetic cue to a particular experimental window. For example, genes implicated in learning may be overexpressed or repressed only during the learning stimulus in a precise region of the intact rodent or primate brain. Further, the invention may be used to induce gene expression changes only during particular stages of disease development. For example, an oncogene may be overexpressed only once a tumor reaches a particular size or metastatic stage. Conversely, proteins suspected in the development of Alzheimer's may be knocked down only at defined time points in the animal's life and within a particular brain region. Although these examples do not exhaustively list the potential applications of the invention, they highlight some of the areas in which the invention may be a powerful technology.

Enzymes According to the Invention can be Used in Combination with Protected Guide RNAs In one aspect, an object of the current invention is to further enhance the specificity of Cpf1 given individual guide RNAs through thermodynamic tuning of the binding specificity of the guide RNA to target DNA. This is a general approach of introducing mismatches, elongation or truncation of the guide sequence to increase/decrease the number of complimentary bases vs. mismatched bases shared between a genomic target and its potential off-target loci, in order to give thermodynamic advantage to targeted genomic loci over genomic off-targets.

In one aspect, the invention provides for the guide sequence being modified by secondary structure to increase the specificity of the Cpf1 CRISPR-Cas system and whereby the secondary structure can protect against exonuclease activity and allow for 3' additions to the guide sequence.

In one aspect, the invention provides for hybridizing a "protector RNA" to a guide sequence, wherein the "protector RNA" is an RNA strand complementary to the 5' end of the guide RNA (gRNA), to thereby generate a partially double-stranded gRNA. In an embodiment of the invention, protecting the mismatched bases with a perfectly complementary protector sequence decreases the likelihood of target DNA binding to the mismatched basepairs at the 3' end. In embodiments of the invention, additional sequences comprising an extented length may also be present.

Guide RNA (gRNA) extensions matching the genomic target provide gRNA protection and enhance specificity. Extension of the gRNA with matching sequence distal to the end of the spacer seed for individual genomic targets is envisaged to provide enhanced specificity. Matching gRNA extensions that enhance specificity have been observed in cells without truncation. Prediction of gRNA structure accompanying these stable length extensions has shown that stable forms arise from protective states, where the extension forms a closed loop with the gRNA seed due to complimentary sequences in the spacer extension and the spacer seed. These results demonstrate that the protected guide concept also includes sequences matching the genomic target sequence distal of the 20mer spacer-binding region. Thermodynamic prediction can be used to predict completely matching or partially matching guide extensions that result in protected gRNA states. This extends the concept of protected gRNAs to interaction between X and Z, where X will generally be of length 17-20nt and Z is of length 1-30nt. Thermodynamic prediction can be used to determine the optimal extension state for Z, potentially introducing small numbers of mismatches in Z to promote the formation of protected conformations between X and Z. Throughout the present application, the terms "X" and seed length (SL) are used interchangeably with the term exposed length (EpL) which denotes the number of nucleotides available for target DNA to bind; the terms "Y" and protector length (PL) are used interchangeably to represent the length of the protector; and the terms "Z", "E", "E'" and EL are used interchangeably to correspond to the term extended length (ExL) which represents the number of nucleotides by which the target sequence is extended.

An extension sequence which corresponds to the extended length (ExL) may optionally be attached directly to the guide sequence at the 3' end of the protected guide sequence. The extension sequence may be 2 to 12 nucleotides in length. Preferably ExL may be denoted as 0, 2, 4, 6, 8, 10 or 12 nucleotides in length. In a preferred embodiment the ExL is denoted as 0 or 4 nuleotides in length. In a more preferred embodiment the ExL is 4 nuleotides in length. The extension sequence may or may not be complementary to the target sequence.

An extension sequence may further optionally be attached directly to the guide sequence at the 5' end of the protected guide sequence as well as to the 3' end of a protecting sequence. As a result, the extension sequence serves as a linking sequence between the protected sequence and the protecting sequence. Without wishing to be bound by theory, such a link may position the protecting sequence near the protected sequence for improved binding of the protecting sequence to the protected sequence.

Addition of gRNA mismatches to the distal end of the gRNA can demonstrate enhanced specificity. The introduction of unprotected distal mismatches in Y or extension of the gRNA with distal mismatches (Z) can demonstrate enhanced specificity. This concept as mentioned is tied to X, Y, and Z components used in protected gRNAs. The unprotected mismatch concept may be further generalized to the concepts of X, Y, and Z described for protected guide RNAs.

Without wishing to be bound by theory, protecting the mismatched bases with a perfectly complementary protector sequence could decrease the likelihood of target DNA binding to the mismatched basepairs at the 3' end. As the double-stranded DNA target is unwound, Cfp1 eventually attempts to interrogate the PAM-distal, 3' end of the target for guide sequence complementarity. However, because the 3' end of the protected guide RNA (pgRNA) is double-stranded, there may be two possible outcomes: 1) guide RNA-protector RNA to guide RNA-target DNA strand exchange will occur and the guide will fully bind the target or 2) the guide RNA will fail to fully bind the target. Because Cpf1 target cleavage is a multiple step kinetic reaction that requires guide RNA:target DNA binding to activate Cas9-catalyzed DSBs, Cpf1 cleavage should not occur if the guide RNA does not properly bind.

In one aspect, the invention provides for enhanced Cpf1 specificity wherein the double stranded 3' end of the protected guide RNA (pgRNA) allows for two possible outcomes: (1) the guide RNA-protector RNA to guide RNA-target DNA strand exchange will occur and the guide will fully bind the target, or (2) the guide RNA will fail to fully bind the target and because Cpf1 target cleavage is a multiple step kinetic reaction that requires guide RNA:target DNA binding to activate Cpf1-catalyzed DSBs, wherein Cpf1 cleavage does not occur if the guide RNA does not properly bind. According to particular embodiments, the protected guide RNA improves specificity of target binding as compared to a naturally occurring CRISPR-Cas system. According to particular embodiments the protected modified guide RNA improves stability as compared to a naturally occurring CRISPR-Cas. According to particular embodiments the protector sequence has a length between 3 and 120 nucleotides and comprises 3 or more contiguous nucleotides complementary to another sequence of guide or protector. According to particular embodiments, the protector sequence forms a hairpin. According to particular embodiments the guide RNA further comprises a protected sequence and an exposed sequence. According to particular embodiments the exposed sequence is 1 to 19 nucleotides. More particularly, the exposed sequence is at least 75%, at least 90% or about 100% complementary to the target sequence. According to particular embodiments the guide sequence is at least 90% or about 100% complementary to the protector strand. According to particular embodiments the guide sequence is at least 75%, at least 90% or about 100% complementary to the target sequence. According to particular embodiments, the guide RNA further comprises an extension sequence. More particularly, the extension sequence is operably linked to the 3' end of the protected guide sequence, and optionally directly linked to the 3' end of the protected guide sequence. According to particular embodiments the extension sequence is 1-12 nucleotides. According to particular embodiments the extension sequence is operably linked to the guide sequence at the 3' end of the protected guide sequence and the 5' end of the protector strand and optionally directly linked to the 3' end of the protected guide sequence and the 3' end of the protector strand, wherein the extension sequence is a linking sequence between the protected sequence and the protector strand. According to particular embodiments the extension sequence is 100% not complementary to the protector strand, optionally at least 95%, at least 90%, at least 80%, at least 70%, at least 60%, or at least 50% not complementary to the protector strand. According to particular embodiments the guide sequence further comprises mismatches appended to the end of the guide sequence, wherein the mismatches thermodynamically optimize specificity.

In one aspect, the invention provides an engineered, non-naturally occurring CRISPR-Cas system comprising a Cpf1 protein and a protected guide RNA that targets a DNA molecule encoding a gene product in a cell, whereby the protected guide RNA targets the DNA molecule encoding the gene product and the Cpf1 protein cleaves the DNA molecule encoding the gene product, whereby expression of the gene product is altered; and, wherein the Cpf1 protein and the protected guide RNA do not naturally occur together. The invention comprehends the protected guide RNA comprising a guide sequence fused 3' to a direct repeat sequence. In some embodiments, the Cpf1 enzyme is *Acidaminococcus* sp. BV3L6, *Lachnospiraceae bacterium* or *Francisella Novicida* Cpf1, and may include mutated Cpf1 derived from these organisms. The enzyme may be a further Cpf1 homolog or ortholog. In some embodiments, the nucleotide sequence encoding the Cfp1 enzyme is codon-optimized for expression in a eukaryotic cell. In some embodiments, the Cpf1 enzyme directs cleavage of one or two strands at the location of the target sequence. In some embodiments, the first regulatory element is a polymerase III promoter. In some embodiments, the second regulatory element is a polymerase II promoter. Advantageous vectors include lentiviruses and adeno-associated viruses, and types of such vectors can also be selected for targeting particular types of cells.

With respect to mutations of the Cpf1 enzyme, when the enzyme is not FnCpf1, mutations may be as described herein elsewhere; conservative substitution for any of the replacement amino acids is also envisaged. In an aspect the invention provides as to any or each or all embodiments herein-discussed wherein the CRISPR enzyme comprises at least one or more, or at least two or more mutations, wherein the at least one or more mutation or the at least two or more mutations are selected from those described herein elsewhere.

In a further aspect, the invention involves a computer-assisted method for identifying or designing potential compounds to fit within or bind to CRISPR-Cpf1 system or a functional portion thereof or vice versa (a computer-assisted method for identifying or designing potential CRISPR-Cpf1 systems or a functional portion thereof for binding to desired compounds) or a computer-assisted method for identifying or designing potential CRISPR-Cpf1 systems (e.g., with regard to predicting areas of the CRISPR-Cpf1 system to be able to be manipulated—for instance, based on crystal structure data or based on data of Cpf1 orthologs, or with respect to where a functional group such as an activator or repressor can be attached to the CRISPR-Cpf1 system, or as to Cpf1 truncations or as to designing nickases), said method comprising: using a computer system, e.g., a programmed computer comprising a processor, a data storage system, an input device, and an output device, the steps of:

(a) inputting into the programmed computer through said input device data comprising the three-dimensional co-ordinates of a subset of the atoms from or pertaining to the CRISPR-Cpf1 crystal structure, e.g., in the CRISPR-Cpf1 system binding domain or alternatively or additionally in domains that vary based on variance among Cpf1 orthologs or as to Cpf1s or as to nickases or as to functional groups, optionally with structural information from CRISPR-Cpf1 system complex(es), thereby generating a data set;

(b) comparing, using said processor, said data set to a computer database of structures stored in said computer data storage system, e.g., structures of compounds that bind or putatively bind or that are desired to bind to a CRISPR-Cpf1 system or as to Cpf1 orthologs (e.g., as Cpf1s or as to domains or regions that vary amongst Cpf1 orthologs) or as to the CRISPR-Cpf1 crystal structure or as to nickases or as to functional groups;

(c) selecting from said database, using computer methods, structure(s)—e.g., CRISPR-Cpf1 structures that may bind to desired structures, desired structures that may bind to certain CRISPR-Cpf1 structures, portions of the CRISPR-Cpf1 system that may be manipulated, e.g., based on data from other portions of the CRISPR-Cpf1 crystal structure and/or from Cpf1 orthologs, truncated Cpf1s, novel nickases or particular functional groups, or positions for attaching functional groups or functional-group-CRISPR-Cpf1 systems;

(d) constructing, using computer methods, a model of the selected structure(s); and (e) outputting to said output device the selected structure(s);

and optionally synthesizing one or more of the selected structure(s);

and further optionally testing said synthesized selected structure(s) as or in a CRISPR-Cpf1 system;

or, said method comprising: providing the co-ordinates of at least two atoms of the CRISPR-Cpf1 crystal structure, e.g., at least two atoms of the herein Crystal Structure Table of the CRISPR-Cpf1 crystal structure or co-ordinates of at least a sub-domain of the CRISPR-Cpf1 crystal structure ("selected co-ordinates"), providing the structure of a candidate comprising a binding molecule or of portions of the CRISPR-Cpf1 system that may be manipulated, e.g., based on data from other portions of the CRISPR-Cpf1 crystal structure and/or from Cpf1 orthologs, or the structure of functional groups, and fitting the structure of the candidate to the selected co-ordinates, to thereby obtain product data comprising CRISPR-Cpf1 structures that may bind to desired structures, desired structures that may bind to certain CRISPR-Cpf1 structures, portions of the CRISPR-Cpf1 system that may be manipulated, truncated Cpf1s, novel nickases, or particular functional groups, or positions for attaching functional groups or functional-group-CRISPR-Cpf1 systems, with output thereof; and optionally synthesizing compound(s) from said product data and further optionally comprising testing said synthesized compound(s) as or in a CRISPR-Cpf1 system.

The testing can comprise analyzing the CRISPR-Cpf1 system resulting from said synthesized selected structure(s), e.g., with respect to binding, or performing a desired function.

The output in the foregoing methods can comprise data transmission, e.g., transmission of information via telecommunication, telephone, video conference, mass communication, e.g., presentation such as a computer presentation (eg POWERPOINT), internet, email, documentary communication such as a computer program (eg WORD) document and the like. Accordingly, the invention also comprehends computer readable media containing: atomic co-ordinate data according to the herein-referenced Crystal Structure, said data defining the three dimensional structure of CRISPR-Cpf1 or at least one sub-domain thereof, or structure factor data for CRISPR-Cpf1, said structure factor data being derivable from the atomic co-ordinate data of herein-referenced Crystal Structure. The computer readable media can also contain any data of the foregoing methods. The invention further comprehends methods a computer system for generating or performing rational design as in the foregoing methods containing either: atomic co-ordinate data according to herein-referenced Crystal Structure, said data defining the three dimensional structure of CRISPR-Cpf1 or at least one sub-domain thereof, or structure factor data for CRISPR-Cpf1, said structure factor data being derivable from the atomic co-ordinate data of herein-referenced Crystal Structure. The invention further comprehends a method of doing business comprising providing to a user the computer system or the media or the three dimensional structure of CRISPR-Cpf1 or at least one sub-domain thereof, or structure factor data for CRISPR-Cpf1, said structure set forth in and said structure factor data being derivable from the atomic co-ordinate data of herein-referenced Crystal Structure, or the herein computer media or a herein data transmission.

A "binding site" or an "active site" comprises or consists essentially of or consists of a site (such as an atom, a functional group of an amino acid residue or a plurality of such atoms and/or groups) in a binding cavity or region, which may bind to a compound such as a nucleic acid molecule, which is/are involved in binding.

By "fitting", is meant determining by automatic, or semi-automatic means, interactions between one or more atoms of a candidate molecule and at least one atom of a structure of the invention, and calculating the extent to which such interactions are stable. Interactions include attraction and repulsion, brought about by charge, steric considerations and the like. Various computer-based methods for fitting are described further By "root mean square (or rms) deviation", we mean the square root of the arithmetic mean of the squares of the deviations from the mean.

By a "computer system", is meant the hardware means, software means and data storage means used to analyze atomic coordinate data. The minimum hardware means of the computer-based systems of the present invention typically comprises a central processing unit (CPU), input means, output means and data storage means. Desirably a display or monitor is provided to visualize structure data. The data storage means may be RAM or means for accessing computer readable media of the invention. Examples of such systems are computer and tablet devices running Unix, Windows or Apple operating systems.

By "computer readable media", is meant any medium or media, which can be read and accessed directly or indirectly by a computer e.g., so that the media is suitable for use in the above-mentioned computer system. Such media include, but are not limited to: magnetic storage media such as floppy discs, hard disc storage medium and magnetic tape; optical storage media such as optical discs or CD-ROM; electrical storage media such as RAM and ROM; thumb drive devices; cloud storage devices and hybrids of these categories such as magnetic/optical storage media.

The invention comprehends the use of the protected guides described herein above in the optimized functional CRISPR-Cas enzyme systems described herein. Formation of a RISC through Guide Engineering In some embodiments, the guide may be a protected guide (e.g. a pgRNA) or an escorted guide (e.g. an esgRNA) as described herein. Both of these, in some embodiments, make use of RISC. A RISC is a key component of RNAi. RISC (RNA-induced silencing complex) is a multiprotein, specifically a ribonucleoprotein, complex which incorporates one strand of a double-stranded RNA (dsRNA) fragment, such as small interfering RNA (siRNA) or microRNA (miRNA), which acts as a template for RISC to recognize a complementary messenger RNA (mRNA) transcript. The mRNA is thus cleaved by one of the components of the RISC.

As such, the formation of a RISC is advantageous in some embodiments. Guide RNAs according to various aspects of the present invention, including but not limited to protected and/or escorted guide RNAs, may be adapted to include RNA nucleotides that promote formation of a RISC, for example in combination with an siRNA or miRNA that may be provided or may, for instance, already be expressed in a cell. This may be useful, for instance, as a self-inactivating system to clear or degrade the guide.

Thus, the guide RNA may comprise a sequence complementary to a target miRNA or an siRNA, which may or may not be present within a cell. In this way, only when the miRNA or siRNA is present, for example through expression (by the cell or through human intervention), is there binding of the RNA sequence to the miRNA or siRNA which then results in cleavage of the guide RNA an RNA-induced silencing complex (RISC) within the cell. Therefore, in some embodiments, the guide RNA comprises an RNA sequence complementary to a target miRNA or siRNA, and binding of the guide RNA sequence to the target miRNA or siRNA results in cleavage of the guide RNA by an RNA-induced silencing complex (RISC) within the cell.

This is explained further below with specific reference to both protected and escorted guides.

RISC Formation Through Use of Protected Guides

For example, a protected guide may be described in the following aspect: an engineered, non-naturally occurring composition comprising a Clustered Regularly Interspaced Short Palindromic Repeats (CRISPR)-CRISPR associated (Cas) (CRISPR-Cas) system having a protected guide RNA (pgRNA) polynucleotide sequence comprising (a) a protector sequence, (b) a direct repeat and (c) a guide sequence capable of hybridizing to a target sequence in a eukaryotic cell, wherein (a), (b), and (c) are arranged in a 5' to 3' orientation, wherein the protector sequence comprises two or more nucleotides that are non-complementary to the target sequence, wherein when transcribed, the guide sequence directs sequence-specific binding of a CRISPR complex to the target sequence, wherein the CRISPR complex comprises a Cpf1 protein complexed with (1) the guide sequence that is hybridized to the target sequence and wherein in the polynucleotide sequence and/or one or more of the guide RNAs are modified.

In one aspect, this protected guide system is used for secondary structure protection for 3' extensions to the gRNA. For example, Applicants extend the gRNA such that a miRNA binding site is introduced to make the gRNA only active when the miRNA binding site is processed and cleaved by the RISC complex machinery. This would not be possible without secondary structure protection since exonuclease processing would start from the 5' end and cut back towards the gRNA. By adding a small secondary structure loop 5' to the added miRNA site, then miRNA may be protected from exonuclease chew back.

RISC Formation Through Use of Escorted Guides

In another example, an escorted guide may be described. In particular, an miRNA Inducible esgRNA is envisaged. Here the escort RNA aptamer sequence is complementary to a target miRNA, so that when the target miRNA is present in a cell incorporated into the RNA-induced silencing complex (RISC), there is binding of the escort RNA aptamer sequence to the target miRNA, which results in cleavage of the esgRNA by an RNA-induced silencing complex (RISC) within the cell.

In alternative embodiments, a wide variety of primary and secondary structures may be provided at the 3' end of the esgRNA, designed so that the RISC complex is able to access the miRNA binding site. An esgRNA may have first and second linker sequences, 3' to a protector sequence. In alternative embodiments, linkers 1 and 2 may for example each independently be 0, 1, 2, 3, or 4 nucleotides long, with a protector sequence of 0, 1 or 2 nucleotides in length.

In an exemplary embodiment, induction of esgRNA targeting may be illustrated using miR-122 in a HEK.293 cell system, in which miR-122 is not expressed natively. In the absence of exogenous miR-122, the protected esgRNAs do not mediate targeted EMX1.3 nuclease activity. When exogenous miR-122 is added (100 ng/well) targeted EMX1.3 cutting was observed (as distinct cleavage artifacts visible as electrophoretic variants on gels). This demonstrates that highly expressed endogenous miRNAs can be utilized in systems that provide genetically inducible sgRNAs. Any miRNA may be used in place of miRNA122, with a corresponding sequence readily determined.

For example, an sgRNA may be linked to an "escort" RNA aptamer sequence complementary to an endogenous target miRNA. The target miRNA may form an RNA-induced silencing complex (RISC) within the cell. When the target miRNA is present in a cell there is binding of the escort RNA aptamer sequence to the target miRNA, which results in cleavage of the esgRNA by the RNA-induced silencing complex (RISC) within the cell. Cleavage of the escort releases the active sgRNA.

For example, a protected guide may be described in the following aspect: a non-naturally occurring or engineered composition comprising an escorted single CRISPR-Cas9 guide RNA (esgRNA) comprising:

an RNA guide sequence capable of hybridizing to a target sequence in a genomic locus of interest in a cell; and,
an escort RNA aptamer sequence,
wherein the escort RNA aptamer sequence comprises binding affinity for an aptamer ligand on or in the cell, or the escort RNA aptamer sequence is responsive to a localized aptamer effector on or in the cell,
wherein the presence of the aptamer ligand or effector on or in the cell is spatially or temporally restricted.

The escort RNA aptamer sequence may be complementary to a target miRNA, which may or may not be present within a cell, so that only when the target miRNA is present is there binding of the escort RNA aptamer sequence to the target miRNA which results in cleavage of the esgRNA by an RNA-induced silencing complex (RISC) within the cell. Therefore, in some embodiments, the escort RNA aptamer sequence is complementary to a target miRNA, and binding of the escort RNA aptamer sequence to the target miRNA results in cleavage of the esgRNA by an RNA-induced silencing complex (RISC) within the cell.

Kits In one aspect, the invention provides kits containing any one or more of the elements disclosed in the above methods and compositions. In some embodiments, the kit comprises a vector system as taught herein and instructions for using the kit. Elements may be provided individually or in combinations, and may be provided in any suitable container, such as a vial, a bottle, or a tube. The kits may include the gRNA and the unbound protector strand as described herein. The kits may include the gRNA with the protector strand bound to at least partially to the guide sequence (i.e. pgRNA). Thus the kits may include the pgRNA in the form of a partially double stranded nucleotide sequence as described here. In some embodiments, the kit includes instructions in one or more languages, for example in more than one language. The instructions may be specific to the applications and methods described herein.

In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g., in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a guide sequence for insertion into a vector so as to operably link the guide sequence and a regulatory element. In some embodiments, the kit comprises a homologous recombination template polynucleotide. In some embodiments, the kit comprises one or more of the vectors and/or one or more of the polynucleotides described herein. The kit may advantageously allows to provide all elements of the systems of the invention.

In one aspect, the invention provides methods for using one or more elements of a CRISPR system. The CRISPR complex of the invention provides an effective means for modifying a target polynucleotide. The CRISPR complex of the invention has a wide variety of utility including modifying (e.g., deleting, inserting, translocating, inactivating, activating) a target polynucleotide in a multiplicity of cell types. As such the CRISPR complex of the invention has a broad spectrum of applications in, e.g., gene therapy, drug screening, disease diagnosis, and prognosis. An exemplary CRISPR complex comprises a CRISPR effector protein complexed with a guide sequence hybridized to a target sequence within the target polynucleotide. In certain embodiments, a direct repeat sequence is linked to the guide sequence.

In one embodiment, this invention provides a method of cleaving a target polynucleotide. The method comprises modifying a target polynucleotide using a CRISPR complex that binds to the target polynucleotide and effect cleavage of said target polynucleotide. Typically, the CRISPR complex of the invention, when introduced into a cell, creates a break (e.g., a single or a double strand break) in the genome sequence. For example, the method can be used to cleave a disease gene in a cell.

The break created by the CRISPR complex can be repaired by a repair processes such as the error prone non-homologous end joining (NHEJ) pathway or the high fidelity homology directed repair (HDR). During these repair process, an exogenous polynucleotide template can be introduced into the genome sequence. In some methods, the HDR process is used to modify genome sequence. For example, an exogenous polynucleotide template comprising a sequence to be integrated flanked by an upstream sequence and a downstream sequence is introduced into a cell. The upstream and downstream sequences share sequence similarity with either side of the site of integration in the chromosome.

Where desired, a donor polynucleotide can be DNA, e.g., a DNA plasmid, a bacterial artificial chromosome (BAC), a yeast artificial chromosome (YAC), a viral vector, a linear piece of DNA, a PCR fragment, a naked nucleic acid, or a nucleic acid complexed with a delivery vehicle such as a liposome or poloxamer.

The exogenous polynucleotide template comprises a sequence to be integrated (e.g., a mutated gene). The sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function.

The upstream and downstream sequences in the exogenous polynucleotide template are selected to promote recombination between the chromosomal sequence of interest and the donor polynucleotide. The upstream sequence is a nucleic acid sequence that shares sequence similarity with the genome sequence upstream of the targeted site for integration. Similarly, the downstream sequence is a nucleic acid sequence that shares sequence similarity with the chromosomal sequence downstream of the targeted site of integration. The upstream and downstream sequences in the exogenous polynucleotide template can have 75%, 80%, 85%, 90%, 95%, or 100% sequence identity with the targeted genome sequence. Preferably, the upstream and downstream sequences in the exogenous polynucleotide template have about 95%, 96%, 97%, 98%, 99%, or 100% sequence identity with the targeted genome sequence. In some methods, the upstream and downstream sequences in the exogenous polynucleotide template have about 99% or 100% sequence identity with the targeted genome sequence.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp.

In some methods, the exogenous polynucleotide template may further comprise a marker. Such a marker may make it easy to screen for targeted integrations. Examples of suitable markers include restriction sites, fluorescent proteins, or selectable markers. The exogenous polynucleotide template of the invention can be constructed using recombinant techniques (see, for example, Sambrook et al., 2001 and Ausubel et al., 1996).

In an exemplary method for modifying a target polynucleotide by integrating an exogenous polynucleotide template, a double stranded break is introduced into the genome sequence by the CRISPR complex, the break is repaired via homologous recombination an exogenous polynucleotide template such that the template is integrated into the genome. The presence of a double-stranded break facilitates integration of the template.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced.

In some methods, a control sequence can be inactivated such that it no longer functions as a control sequence. As used herein, "control sequence" refers to any nucleic acid sequence that effects the transcription, translation, or accessibility of a nucleic acid sequence. Examples of a control sequence include, a promoter, a transcription terminator, and an enhancer are control sequences. The inactivated target sequence may include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). In some methods, the inactivation of a target sequence results in "knockout" of the target sequence.

Exemplary Methods of Using of CRISPR Cas System

The invention provides a non-naturally occurring or engineered composition, or one or more polynucleotides encoding components of said composition, or vector or delivery systems comprising one or more polynucleotides encoding components of said composition for use in a modifying a target cell in vivo, ex vivo or in vitro and, may be conducted in a manner alters the cell such that once modified the progeny or cell line of the CRISPR modified cell retains the altered phenotype. The modified cells and progeny may be part of a multi-cellular organism such as a plant or animal with ex vivo or in vivo application of CRISPR system to desired cell types. The CRISPR invention may be a therapeutic method of treatment. The therapeutic method of treatment may comprise gene or genome editing, or gene therapy.

Use of Inactivated CRISPR Cpf1 Enzyme for Detection Methods Such as FISH

In one aspect, the invention provides an engineered, non-naturally occurring CRISPR-Cas system comprising a catalytically inactivate Cas protein described herein, preferably an inactivate Cpf1 (dCpf1), and use this system in detection methods such as fluorescence in situ hybridization (FISH). dCpf1 which lacks the ability to produce DNA double-strand breaks may be fused with a marker, such as fluorescent protein, such as the enhanced green fluorescent protein (eEGFP) and co-expressed with small guide RNAs to target pericentric, centric and teleomeric repeats in vivo. The dCpf1 system can be used to visualize both repetitive sequences and individual genes in the human genome. Such new applications of labelled dCpf1 CRISPR-cas systems may be important in imaging cells and studying the functional nuclear architecture, especially in cases with a small nucleus volume or complex 3-D structures. (Chen B, Gilbert L A, Cimini B A, Schnitzbauer J, Zhang W, Li G W, Park J, Blackburn E H, Weissman J S, Qi L S, Huang B. 2013. Dynamic imaging of genomic loci in living human cells by an optimized CRISPR/Cas system. Cell 155(7):1479-91. doi: 10.1016/j.cell.2013.12.001.)

Use of CRISPR Cpf1 for Modification/Detection of DNA

The CRISPR Cpf1 systems and methods of use thereof are of interest for targeting and optionally genetic modification of DNA, irrespective of its origin. Thus the DNA can be prokaryotic, eukaryotic or viral DNA. Different applications for targeting eukaryotic DNA, within or outside a cell are detailed herein elsewhere. In particular embodiments, the Cpf1 system is used to target microbial, such as prokaryotic DNA. This can be of interest in the context of recombinant production of molecules of interest in organisms such as yeast or fungi. In this context, the invention envisages methods for the recombinant production of a compound of interest in a host cell, which comprise the use of the Cpf1 system for genetically modifying the host cell, such as yeast, fungi or bacteria so as to ensure production of said compound. The application further envisages compounds obtained by these methods. Additionally or alternatively this can be of interest in the context of detection and/or modification of bacterial or viral DNA. In particular embodiments, the methods involve specific detection and/or modification of bacterial or viral DNA.

Use of CRISPR Cpf1 for Degradation of Contaminant DNA

In particular embodiments, the Cpf1 effector protein is used to target and cleave contaminant DNA. For instance, in particular embodiments eukaryotic DNA is a contaminant in a sample, e.g. where detection of non-eukaryotic, such as viral or bacterial DNA is of interest in a tissue or fluid sample of a eukaryote. Targeting of eukaryotic DNA is ensured by using eukaryote (e.g. human) specific guide sequences. These methods may or may not involve lysing the cells present in the sample prior to targeting the eukaryotic DNA. After selective cleavage of the eukaryotic DNA, this can be separated from intact DNA present in the sample by methods known in the art. Accordingly, the invention provides for methods for selectively removing eukaryotic (e.g. human) DNA from a sample, which methods comprise selectively cleaving the eukaryotic DNA with the CRISPR-Cpf1 system described herein. Also provided herein are kits for carrying out these methods comprising one or more components of the CRISPR-Cpf1 system described herein which allow selective targeting of eukaryotic DNA. Similarly it is envisaged that species-specific removal of contaminating DNA can be ensured.

Modifying a Target with CRISPR Cas System or Complex (e.g., Cpf1-RNA Complex)

In one aspect, the invention provides for methods of modifying a target polynucleotide in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

In one aspect, the invention provides a method of modifying a target polynucleotide in a eukaryotic cell. In some embodiments, the method comprises allowing a CRISPR complex to bind to the target polynucleotide to effect cleavage of said target polynucleotide thereby modifying the target polynucleotide, wherein the CRISPR complex comprises a Cpf1 enzyme complexed with protected guide RNA comprising a guide sequence hybridized to a target sequence within said target polynucleotide. In some embodiments, said cleavage comprises cleaving one or two strands at the location of the target sequence by said Cpf1 enzyme. In some embodiments, said cleavage results in decreased transcription of a target gene. In some embodiments, the method further comprises repairing said cleaved target polynucleotide by homologous recombination with an exogenous template polynucleotide or non-homologous end joining (NHEJ)-based gene insertion mechanisms, wherein said repair results in a mutation comprising an insertion, deletion, or substitution of one or more nucleotides of said target polynucleotide. In some embodiments, said mutation results in one or more amino acid changes in a protein expressed from a gene comprising the target sequence. In some embodiments, the method further comprises delivering one or more vectors to said eukaryotic cell, wherein the one or more vectors drive expression of one or more of: the Cpf1 enzyme, the protected guide RNA comprising the guide sequence linked to direct repeat sequence. In some embodiments, said vectors are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject.

Indeed, in any aspect of the invention, the CRISPR complex may comprise a CRISPR enzyme complexed with a guide sequence hybridized or hybridizable to a target sequence. Similar considerations and conditions apply as above for methods of modifying a target polynucleotide. Thus in any of the non-naturally-occurring CRISPR enzymes described herein comprise at least one modification and whereby the enzyme has certain improved capabilities. In particular, any of the enzymes are capable of forming a CRISPR complex with a guide RNA. When such a complex forms, the guide RNA is capable of binding to a target polynucleotide sequence and the enzyme is capable of modifying a target locus. In addition, the enzyme in the CRISPR complex has reduced capability of modifying one or more off-target loci as compared to an unmodified enzyme.

In addition, the modified CRISPR emzymes described herein encompass enzymes whereby in the CRISPR complex the enzyme has increased capability of modifying the one or more target loci as compared to an unmodified enzyme. Such function may be provided separate to or provided in combination with the above-described function of reduced capability of modifying one or more off-target loci. Any such enzymes may be provided with any of the further modifications to the CRISPR enzyme as described herein, such as in combination with any activity provided by one or more associated heterologous functional domains, any further mutations to reduce nuclease activity and the like.

In advantageous embodiments of the invention, the modified CRISPR emzyme is provided with reduced capability of modifying one or more off-target loci as compared to an unmodified enzyme and increased capability of modifying the one or more target loci as compared to an unmodified enzyme. In combination with further modifications to the enzyme, significantly enhanced specificity may be achieved. For example, combination of such advantageous embodiments with one or more additional mutations is provided wherein the one or more additional mutations are in one or more catalytically active domains. Such further catalytic mutations may confer nickase functionality as described in detail elsewhere herein. In such enzymes, enhanced specificity may be achieved due to an improved specificity in terms of enzyme activity.

Modifications to reduce off-target effects and/or enhance on-target effects as described above may be made to amino acid residues located in a positively-charged region/groove situated between the RuvC-III and HNH domains. It will be appreciated that any of the functional effects described above may be achieved by modification of amino acids within the aforementioned groove but also by modification of amino acids adjacent to or outside of that groove. Additional functionalities which may be engineered into modified CRISPR enzymes as described herein include the following. 1. modified CRISPR enzymes that disrupt DNA:protein interactions without affecting protein tertiary or secondary structure. This includes residues that contact any part of the RNA:DNA duplex. 2. modified CRISPR enzymes that weaken intra-protein interactions holding Cpf1 in conformation essential for nuclease cutting in response to DNA binding (on or off target). For example: a modification that mildly inhibits, but still allows, the nuclease conformation of the HNH domain (positioned at the scissile phosphate). 3. modified CRISPR enzymes that strengthen intra-protein interactions holding Cpf1 in a conformation inhibiting nuclease activity in response to DNA binding (on or off targets). For example: a modification that stabilizes the HNH domain in a conformation away from the scissile phosphate. Any such additional functional enhancement may be provided in combination with any other modification to the CRISPR enzyme as described in detail elsewhere herein.

Any of the herein described improved functionalities may be made to any CRISPR enzyme, such as a Cpf1 enzyme. However, it will be appreciated that any of the functionalities described herein may be engineered into Cpf1 enzymes from other orthologs, including chimeric enzymes comprising fragments from multiple orthologs.

Nucleic Acids, Amino Acids and Proteins, Regulatory Sequences, Vectors, Etc.

The invention uses nucleic acids to bind target DNA sequences. This is advantageous as nucleic acids are much easier and cheaper to produce than proteins, and the specificity can be varied according to the length of the stretch where homology is sought. Complex 3-D positioning of multiple fingers, for example is not required. The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridising to the reference sequence under highly stringent conditions. Generally, in order to maximize the hybridization rate, relatively low-stringency hybridization conditions are selected: about 20 to 25° C. lower than the thermal melting point ($T_m$). The $T_m$ is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15° C. lower than the $T_m$. In order to require at least about 70% nucleotide complementarity of hybridized sequences, moderately-stringent washing conditions are selected to be about 15 to 30° C. lower than the $T_m$. Highly permissive (very low stringency) washing conditions may be as low as 50° C. below the $T_m$, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C. "Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life-eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell. The terms "polypeptide", "peptide" and "protein" are used interchangeably herein to refer to polymers of amino acids of any length. The polymer may be linear or branched, it may comprise modified amino acids, and it may be interrupted by non amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

In aspects of the invention the term "guide RNA", refers to the polynucleotide sequence comprising a putative or identified crRNA sequence or guide sequence.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, the may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered." Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is -12 for a gap and -4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 Nuc. Acids Research 12 p 387). Examples of other software than may perform sequence comparisons include, but are not limited to, the BLAST package (see Ausubel et al., 1999 Short Protocols in Molecular Biology, 4$^{th}$ Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, Short Protocols in Molecular Biology, pages 7-58 to 7-60). However, for some applications, it is preferred to use the GCG Bestfit program. A new tool, called BLAST 2 Sequences is also available for comparing protein and nucleotide sequences (see FEMS Microbiol Lett. 1999 174(2): 247-50; FEMS Microbiol Lett. 1999 177(1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), Gene 73(1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C.D. and Barton G. J. (1993) "Protein sequence alignments: a strategy for the hierarchical analysis of residue conservation" Comput. Appl. Biosci. 9: 745-756) (Taylor W. R. (1986) "The classification of amino acid conservation" J. Theor. Biol. 119; 205-218). Conservative substitutions may be made, for example according to the table below which describes a generally accepted Venn diagram grouping of amino acids.

| Set | Sub-set | |
|---|---|---|
| Hydro-phobic F W Y H K M I L V A G C | Aromatic | F W Y H |
| | Aliphatic | I L V |
| Polar W Y H K R E D C S T N Q | Charged | H K R E D |
| | Positively charged | H K R |
| | Negatively charged | E D |
| Small V C A G S P T N D | Tiny | A G S |

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., *PNAS* (1992) 89(20), 9367-9371 and Horwell D C, *Trends Biotechnol.* (1995) 13(4), 132-134.

Homology modelling: Corresponding residues in other Cpf1 orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair a query proteins and using structural alignment to identify structural representatives that correspond to either their experimentally determined structures or homology models. Structural alignment is further used to identify both close and remote structural neighbours by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbour in the template. This approach is further described in Dey et al., 2013 (Prot Sci; 22: 359-66).

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of *E. coli* DNA polymerase, and reverse transcriptase. A preferred amplification method is PCR.

Aspects of the invention relate to bicistronic vectors for guide RNA and (optionally modified or mutated) CRISPR enzymes (e.g. Cpf1). Bicistronic expression vectors for guide RNA and (optionally modified or mutated) CRISPR enzymes are preferred. In general and particularly in this embodiment (optionally modified or mutated) CRISPR enzymes are preferably driven by the CBh promoter. The RNA may preferably be driven by a Pol III promoter, such as a U6 promoter. Ideally the two are combined.

In some embodiments, a loop in the guide RNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG. In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase. Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89). In some embodiments, a vector is a yeast expression vector. Examples of vectors for expression in yeast *Saccharomyces cerivisae* include pYepSec1 (Baldari, et al., 1987. EMBO J. 6: 229-234), pMFa (Kuijan and Herskowitz, 1982. Cell 30: 933-943), pJRY88 (Schultz et al., 1987. Gene 54: 113-123), pYES2 (Invitrogen Corporation, San Diego, Calif.), and picZ (InVitrogen Corp, San Diego, Calif.). In some embodiments, a vector drives protein expression in insect cells using baculovirus expression vectors. Baculovirus vectors available for expression of proteins in cultured insect cells (e.g., SF9 cells) include the pAc series (Smith, et al., 1983. Mol. Cell. Biol. 3: 2156-2165) and the pVL series (Lucklow and Summers, 1989. Virology 170: 31-39).

In some embodiments, a vector is capable of driving expression of one or more sequences in mammalian cells using a mammalian expression vector. Examples of mammalian expression vectors include pCDM8 (Seed, 1987. Nature 329: 840) and pMT2PC (Kaufman, et al., 1987. EMBO J. 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol. 43: 235-275), in particular promoters of T cell receptors (Winoto and Baltimore, 1989. EMBO J. 8: 729-733) and immunoglobulins (Baneiji, et al., 1983. Cell 33: 729-740; Queen and Baltimore, 1983. Cell 33: 741-748), neuron-specific promoters (e.g., the neurofilament promoter; Byrne and Ruddle, 1989. Proc. Natl. Acad. Sci. USA 86: 5473-5477), pancreas-specific promoters (Edlund, et al., 1985. Science 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249: 374-379) and the α-fetoprotein promoter (Campes and Tilghman, 1989. Genes Dev. 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety. In some embodiments, a regulatory element is operably linked to one or more elements of a CRISPR system so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis* (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to Aeropyrum, *Pyrobaculum, Sulfolobus, Archaeoglobus, Halocarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azarcus, Chromobacterium, Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema*, and *Thermotoga*.

In general, "nucleic acid-targeting system" as used in the present application refers collectively to transcripts and other elements involved in the expression of or directing the activity of nucleic acid-targeting CRISPR-associated ("Cas") genes (also referred to herein as an effector protein), including sequences encoding a nucleic acid-targeting Cas (effector) protein and a guide RNA or other sequences and transcripts from a nucleic acid-targeting CRISPR locus. In some embodiments, one or more elements of a nucleic acid-targeting system are derived from a Type V nucleic acid-targeting CRISPR system. In some embodiments, one or more elements of a nucleic acid-targeting system is derived from a particular organism comprising an endogenous nucleic acid-targeting CRISPR system. In general, a nucleic acid-targeting system is characterized by elements that promote the formation of a nucleic acid-targeting complex at the site of a target sequence. In the context of formation of a nucleic acid-targeting complex, "target sequence" refers to a sequence to which a guide sequence is designed to have complementarity, where hybridization between a target sequence and a guide RNA promotes the formation of a DNA-targeting complex. Full complementarity is not necessarily required, provided there is sufficient complementarity to cause hybridization and promote formation of a nucleic acid-targeting complex. A target sequence may comprise RNA polynucleotides. In some embodiments, a target sequence is located in the nucleus or cytoplasm of a cell. In some embodiments, the target sequence may be within an organelle of a eukaryotic cell, for example, mitochondrion or chloroplast. A sequence or template that may be used for recombination into the targeted locus comprising the target sequences is referred to as an "editing template" or "editing RNA" or "editing sequence". In aspects of the invention, an exogenous template RNA may be referred to as an editing template. In an aspect of the invention the recombination is homologous recombination.

Typically, in the context of an endogenous nucleic acid-targeting system, formation of a nucleic acid-targeting complex (comprising a guide RNA hybridized to a target sequence and complexed with one or more nucleic acid-targeting effector proteins) results in cleavage of one or both DNA strands in or near (e.g. within 1, 2, 3, 4, 5, 6, 7, 8, 9, 10, 20, 50, or more base pairs from) the target sequence. In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector protein and a guide RNA could each be operably linked to separate regulatory elements on separate vectors. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and a guide RNA embedded within one or more intron sequences (e.g. each in a different intron, two or more in at least one intron, or all in a single intron). In some embodiments, the nucleic acid-targeting effector protein and guide RNA are operably linked to and expressed from the same promoter.

A guide sequence may be selected to target any target sequence. In some embodiments, the target sequence is a sequence within a gene transcript or mRNA.

In some embodiments, the target sequence is a sequence within a genome of a cell. In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, *Cell* 106(1): 23-24; and P A Carr and G M Church, 2009, *Nature Biotechnology* 27(12): 1151-62).

In some embodiments, a recombination template is also provided. A recombination template may be a component of another vector as described herein, contained in a separate vector, or provided as a separate polynucleotide. In some embodiments, a recombination template is designed to serve as a template in homologous recombination, such as within or near a target sequence nicked or cleaved by a nucleic acid-targeting effector protein as a part of a nucleic acid-targeting complex. A template polynucleotide may be of any suitable length, such as about or more than about 10, 15, 20, 25, 50, 75, 100, 150, 200, 500, 1000, or more nucleotides in length. In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

In some embodiments, the nucleic acid-targeting effector protein is part of a fusion protein comprising one or more heterologous protein domains (e.g., about or more than about 1, 2, 3, 4, 5, 6, 7, 8, 9, 10, or more domains in addition to the nucleic acid-targeting effector protein). In some embodiments, the CRISPR effector protein is part of a fusion protein comprising one or more heterologous protein domains (e.g. about or more than about 1, 2, 3, 4, 5, 6, 7, 8, 9, 10, or more domains in addition to the CRISPR enzyme). A CRISPR enzyme fusion protein may comprise any additional protein sequence, and optionally a linker sequence between any two domains. Examples of protein domains that may be fused to a CRISPR enzyme include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A CRISPR enzyme may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a CRISPR enzyme are described in US20110059502, incorporated herein by reference. In some embodiments, a tagged CRISPR enzyme is used to identify the location of a target sequence.

Options for DNA/RNA or DNA/DNA or RNA/RNA or Protein/RNA

In some embodiments, the components of the CRISPR system may be delivered in various form, such as combinations of DNA/RNA or RNA/RNA or protein RNA. For example, the Cpf1 may be delivered as a DNA-coding polynucleotide or an RNA-coding polynucleotide or as a protein. The guide may be delivered may be delivered as a DNA-coding polynucleotide or an RNA. All possible combinations are envisioned, including mixed forms of delivery.

In some embodiments, all such combinations (DNA/RNA or DNA/DNA or RNA/RNA or protein/RNA).

In some embodiment, when the Cpf1 is delivered in protein form, it is possible to pre-assemble same with one or more guide/s.

Nanoclews

Further, the CRISPR system may be delivered using nanoclews, for example as described in Sun W et al, *Cocoon-like self-degradable DNA nanoclew for anticancer drug delivery*, J Am Chem Soc. 2014 Oct. 22; 136(42): 14722-5. doi: 10.1021/ja5088024. Epub 2014 Oct. 13. or in Sun W et al, *Self-Assembled DNA Nanoclews for the Efficient Delivery of CRISPR-Cas9 for Genome Editing*, Angew Chem Int Ed Engl. 2015 Oct. 5; 54(41):12029-33. doi: 10.1002/anie.201506030. Epub 2015 Aug. 27.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)).

Models of Genetic and Epigenetic Conditions

A method of the invention may be used to create a plant, an animal or cell that may be used to model and/or study genetic or epitgenetic conditions of interest, such as a through a model of mutations of interest or a disease model. As used herein, "disease" refers to a disease, disorder, or indication in a subject. For example, a method of the invention may be used to create an animal or cell that comprises a modification in one or more nucleic acid sequences associated with a disease, or a plant, animal or cell in which the expression of one or more nucleic acid sequences associated with a disease are altered. Such a nucleic acid sequence may encode a disease associated protein sequence or may be a disease associated control sequence. Accordingly, it is understood that in embodiments of the invention, a plant, subject, patient, organism or cell can be a non-human subject, patient, organism or cell. Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants. In the instance where the cell is in cultured, a cell line may be established if appropriate culturing conditions are met and preferably if the cell is suitably adapted for this purpose (for instance a stem cell). Bacterial cell lines produced by the invention are also envisaged. Hence, cell lines are also envisaged.

In some methods, the disease model can be used to study the effects of mutations on the animal or cell and development and/or progression of the disease using measures commonly used in the study of the disease. Alternatively, such a disease model is useful for studying the effect of a pharmaceutically active compound on the disease.

In some methods, the disease model can be used to assess the efficacy of a potential gene therapy strategy. That is, a disease-associated gene or polynucleotide can be modified such that the disease development and/or progression is inhibited or reduced. In particular, the method comprises modifying a disease-associated gene or polynucleotide such that an altered protein is produced and, as a result, the animal or cell has an altered response. Accordingly, in some methods, a genetically modified animal may be compared with an animal predisposed to development of the disease such that the effect of the gene therapy event may be assessed.

In another embodiment, this invention provides a method of developing a biologically active agent that modulates a cell signaling event associated with a disease gene. The method comprises contacting a test compound with a cell comprising one or more vectors that drive expression of one or more of a CRISPR enzyme, and a direct repeat sequence linked to a guide sequence; and detecting a change in a readout that is indicative of a reduction or an augmentation of a cell signaling event associated with, e.g., a mutation in a disease gene contained in the cell.

A cell model or animal model can be constructed in combination with the method of the invention for screening a cellular function change. Such a model may be used to study the effects of a genome sequence modified by the CRISPR complex of the invention on a cellular function of interest. For example, a cellular function model may be used to study the effect of a modified genome sequence on intracellular signaling or extracellular signaling. Alternatively, a cellular function model may be used to study the effects of a modified genome sequence on sensory perception. In some such models, one or more genome sequences associated with a signaling biochemical pathway in the model are modified.

Several disease models have been specifically investigated. These include de novo autism risk genes CHD8, KATNAL2, and SCN2A; and the syndromic autism (Angelman Syndrome) gene UBE3A. These genes and resulting autism models are of course preferred, but serve to show the broad applicability of the invention across genes and corresponding models. An altered expression of one or more genome sequences associated with a signalling biochemical pathway can be determined by assaying for a difference in the mRNA levels of the corresponding genes between the test model cell and a control cell, when they are contacted with a candidate agent. Alternatively, the differential expression of the sequences associated with a signaling biochemical pathway is determined by detecting a difference in the level of the encoded polypeptide or gene product.

To assay for an agent-induced alteration in the level of mRNA transcripts or corresponding polynucleotides, nucleic acid contained in a sample is first extracted according to standard methods in the art. For instance, mRNA can be isolated using various lytic enzymes or chemical solutions according to the procedures set forth in Sambrook et al. (1989), or extracted by nucleic-acid-binding resins following the accompanying instructions provided by the manufacturers. The mRNA contained in the extracted nucleic acid sample is then detected by amplification procedures or conventional hybridization assays (e.g. Northern blot analysis) according to methods widely known in the art or based on the methods exemplified herein.

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of E. coli DNA polymerase, and reverse transcriptase. A preferred amplification method is PCR. In particular, the isolated RNA can be subjected to a reverse transcription assay that is coupled with a quantitative polymerase chain reaction (RT-PCR) in order to quantify the expression level of a sequence associated with a signaling biochemical pathway.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double-stranded DNA molecules is typically proportional to the amount of the amplified DNA products, one can conveniently determine the amount of the amplified products by quantifying the fluorescence of the intercalated dye using conventional optical systems in the art. DNA-binding dye suitable for this application include SYBR green, SYBR blue, DAPI, propidium iodine, Hoeste, SYBR gold, ethidium bromide, acridines, proflavine, acridine orange, acriflavine, fluorcoumanin, ellipticine, daunomycin, chloroquine, distamycin D, chromomycin, homidium, mithramycin, ruthenium polypyridyls, anthramycin, and the like.

In another aspect, other fluorescent labels such as sequence specific probes can be employed in the amplification reaction to facilitate the detection and quantification of the amplified products. Probe-based quantitative amplification relies on the sequence-specific detection of a desired amplified product. It utilizes fluorescent, target-specific probes (e.g., TaqMan® probes) resulting in increased specificity and sensitivity. Methods for performing probe-based quantitative amplification are well established in the art and are taught in U.S. Pat. No. 5,210,015.

In yet another aspect, conventional hybridization assays using hybridization probes that share sequence homology with sequences associated with a signaling biochemical pathway can be performed. Typically, probes are allowed to form stable complexes with the sequences associated with a signaling biochemical pathway contained within the biological sample derived from the test subject in a hybridization reaction. It will be appreciated by one of skill in the art that where antisense is used as the probe nucleic acid, the target polynucleotides provided in the sample are chosen to be complementary to sequences of the antisense nucleic acids. Conversely, where the nucleotide probe is a sense nucleic acid, the target polynucleotide is selected to be complementary to sequences of the sense nucleic acid.

Hybridization can be performed under conditions of various stringency. Suitable hybridization conditions for the practice of the present invention are such that the recognition interaction between the probe and sequences associated with a signaling biochemical pathway is both sufficiently specific and sufficiently stable. Conditions that increase the stringency of a hybridization reaction are widely known and published in the art. See, for example, (Sambrook, et al., (1989); Nonradioactive In Situ Hybridization Application Manual, Boehringer Mannheim, second edition). The hybridization assay can be formed using probes immobilized on any solid support, including but are not limited to nitrocellulose, glass, silicon, and a variety of gene arrays. A preferred hybridization assay is conducted on high-density gene chips as described in U.S. Pat. No. 5,445,934.

For a convenient detection of the probe-target complexes formed during the hybridization assay, the nucleotide probes are conjugated to a detectable label. Detectable labels suitable for use in the present invention include any composition detectable by photochemical, biochemical, spectroscopic, immunochemical, electrical, optical or chemical means. A wide variety of appropriate detectable labels are known in the art, which include fluorescent or chemiluminescent labels, radioactive isotope labels, enzymatic or other ligands. In preferred embodiments, one will likely desire to employ a fluorescent label or an enzyme tag, such as digoxigenin, β-galactosidase, urease, alkaline phosphatase or peroxidase, avidin/biotin complex.

The detection methods used to detect or quantify the hybridization intensity will typically depend upon the label selected above. For example, radiolabels may be detected using photographic film or a phosphoimager. Fluorescent markers may be detected and quantified using a photodetector to detect emitted light. Enzymatic labels are typically detected by providing the enzyme with a substrate and measuring the reaction product produced by the action of the enzyme on the substrate; and finally colorimetric labels are detected by simply visualizing the colored label.

An agent-induced change in expression of sequences associated with a signalling biochemical pathway can also be determined by examining the corresponding gene products. Determining the protein level typically involves a) contacting the protein contained in a biological sample with an agent that specifically bind to a protein associated with a signalling biochemical pathway; and (b) identifying any agent:protein complex so formed. In one aspect of this embodiment, the agent that specifically binds a protein associated with a signalling biochemical pathway is an antibody, preferably a monoclonal antibody.

The reaction is performed by contacting the agent with a sample of the proteins associated with a signaling biochemical pathway derived from the test samples under conditions that will allow a complex to form between the agent and the proteins associated with a signalling biochemical pathway. The formation of the complex can be detected directly or indirectly according to standard procedures in the art. In the direct detection method, the agents are supplied with a detectable label and unreacted agents may be removed from the complex; the amount of remaining label thereby indicating the amount of complex formed. For such method, it is preferable to select labels that remain attached to the agents even during stringent washing conditions. It is preferable that the label does not interfere with the binding reaction. In the alternative, an indirect detection procedure may use an agent that contains a label introduced either chemically or enzymatically. A desirable label generally does not interfere with binding or the stability of the resulting agent:polypeptide complex. However, the label is typically designed to be accessible to an antibody for an effective binding and hence generating a detectable signal. A wide variety of labels suitable for detecting protein levels are known in the art. Non-limiting examples include radioisotopes, enzymes, colloidal metals, fluorescent compounds, bioluminescent compounds, and chemiluminescent compounds.

The amount of agent:polypeptide complexes formed during the binding reaction can be quantified by standard quantitative assays. As illustrated above, the formation of agent:polypeptide complex can be measured directly by the amount of label remained at the site of binding. In an alternative, the protein associated with a signaling biochemical pathway is tested for its ability to compete with a labeled analog for binding sites on the specific agent. In this competitive assay, the amount of label captured is inversely proportional to the amount of protein sequences associated with a signaling biochemical pathway present in a test sample.

A number of techniques for protein analysis based on the general principles outlined above are available in the art. They include but are not limited to radioimmunoassays, ELISA (enzyme linked immunoradiometric assays), "sandwich" immunoassays, immunoradiometric assays, in situ immunoassays (using e.g., colloidal gold, enzyme or radio-isotope labels), western blot analysis, immunoprecipitation assays, immunofluorescent assays, and SDS-PAGE.

Antibodies that specifically recognize or bind to proteins associated with a signalling biochemical pathway are preferable for conducting the aforementioned protein analyses. Where desired, antibodies that recognize a specific type of post-translational modifications (e.g., signaling biochemical pathway inducible modifications) can be used. Post-translational modifications include but are not limited to glycosylation, lipidation, acetylation, and phosphorylation. These antibodies may be purchased from commercial vendors. For example, anti-phosphotyrosine antibodies that specifically recognize tyrosine-phosphorylated proteins are available from a number of vendors including Invitrogen and Perkin Elmer. Anti-phosphotyrosine antibodies are particularly useful in detecting proteins that are differentially phosphorylated on their tyrosine residues in response to an ER stress. Such proteins include but are not limited to eukaryotic translation initiation factor 2 alpha (eIF-2$\alpha$). Alternatively, these antibodies can be generated using conventional polyclonal or monoclonal antibody technologies by immunizing a host animal or an antibody-producing cell with a target protein that exhibits the desired post-translational modification.

In practicing the subject method, it may be desirable to discern the expression pattern of an protein associated with a signaling biochemical pathway in different bodily tissue, in different cell types, and/or in different subcellular structures. These studies can be performed with the use of tissue-specific, cell-specific or subcellular structure specific antibodies capable of binding to protein markers that are preferentially expressed in certain tissues, cell types, or subcellular structures.

An altered expression of a gene associated with a signaling biochemical pathway can also be determined by examining a change in activity of the gene product relative to a control cell. The assay for an agent-induced change in the activity of a protein associated with a signaling biochemical pathway will dependent on the biological activity and/or the signal transduction pathway that is under investigation. For example, where the protein is a kinase, a change in its ability to phosphorylate the downstream substrate(s) can be determined by a variety of assays known in the art. Representative assays include but are not limited to immunoblotting and immunoprecipitation with antibodies such as anti-phosphotyrosine antibodies that recognize phosphorylated proteins. In addition, kinase activity can be detected by high throughput chemiluminescent assays such as AlphaScreen™ (available from Perkin Elmer) and eTag™ assay (Chan-Hui, et al. (2003) Clinical Immunology 111: 162-174).

Where the protein associated with a signaling biochemical pathway is part of a signaling cascade leading to a fluctuation of intracellular pH condition, pH sensitive molecules such as fluorescent pH dyes can be used as the reporter molecules. In another example where the protein associated with a signaling biochemical pathway is an ion channel, fluctuations in membrane potential and/or intracellular ion concentration can be monitored. A number of commercial kits and high-throughput devices are particularly suited for a rapid and robust screening for modulators of ion channels. Representative instruments include FLIPR™ (Molecular Devices, Inc.) and VIPR (Aurora Biosciences). These instruments are capable of detecting reactions in over 1000 sample wells of a microplate simultaneously, and providing real-time measurement and functional data within a second or even a minisecond.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA).

Examples of target polynucleotides include a sequence associated with a signalling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). Without wishing to be bound by theory, it is believed that the target sequence should be associated with a PAM (protospacer adjacent motif); that is, a short sequence recognized by the CRISPR complex. The precise sequence and length requirements for the PAM differ depending on the CRISPR enzyme used, but PAMs are typically 2-5 base pair sequences adjacent the protospacer (that is, the target sequence) Examples of PAM sequences are given in the examples section below, and the skilled person will be able to identify further PAM sequences for use with a given CRISPR enzyme. Further, engineering of the PAM Interacting (PI) domain may allow programing of PAM specificity, improve target site recognition fidelity, and increase the versatility of the Cas, e.g. Cas9, genome engineering platform. Cas proteins, such as Cas9 proteins may be engineered to alter their PAM specificity, for example as described in Kleinstiver B P et al. *Engineered CRISPR-Cas9 nucleases with altered PAM specificities*. Nature. 2015 Jul. 23; 523(7561):481-5. doi: 10.1038/nature14592.

The target polynucleotide of a CRISPR complex may include a number of disease-associated genes and polynucleotides as well as signaling biochemical pathway-associated genes and polynucleotides as listed in U.S. provisional patent applications 61/736,527 and 61/748,427 having Broad reference, both entitled SYSTEMS METHODS AND COMPOSITIONS FOR SEQUENCE MANIPULATION filed on Dec. 12, 2012 and Jan. 2, 2013, respectively, and PCT Application PCT/US2013/074667, entitled DELIVERY, ENGINEERING AND OPTIMIZATION OF SYSTEMS, METHODS AND COMPOSITIONS FOR SEQUENCE MANIPULATION AND THERAPEUTIC APPLICATIONS, filed Dec. 12, 2013, the contents of all of which are herein incorporated by reference in their entirety.

Examples of target polynucleotides include a sequence associated with a signalling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

Genome Wide Knock-Out Screening

The CRISPR proteins and systems described herein can be used to perform efficient and cost effective functional genomic screens. Such screens can utilize CRISPR effector protein based genome wide libraries. Such screens and libraries can provide for determining the function of genes, cellular pathways genes are involved in, and how any alteration in gene expression can result in a particular biological process. An advantage of the present invention is that the CRISPR system avoids off-target binding and its resulting side effects. This is achieved using systems arranged to have a high degree of sequence specificity for the target DNA. In preferred embodiments of the invention, the CRISPR effector protein complexes are Cpf1 effector protein complexes.

In embodiments of the invention, a genome wide library may comprise a plurality of Cpf1 guide RNAs, as described herein, comprising guide sequences that are capable of targeting a plurality of target sequences in a plurality of genomic loci in a population of eukaryotic cells. The population of cells may be a population of embryonic stem (ES) cells. The target sequence in the genomic locus may be a non-coding sequence. The non-coding sequence may be an intron, regulatory sequence, splice site, 3' UTR, 5' UTR, or polyadenylation signal. Gene function of one or more gene products may be altered by said targeting. The targeting may result in a knockout of gene function. The targeting of a gene product may comprise more than one guide RNA. A gene product may be targeted by 2, 3, 4, 5, 6, 7, 8, 9, or 10 guide RNAs, preferably 3 to 4 per gene. Off-target modifications may be minimized by exploiting the staggered double strand breaks generated by Cpf1 effector protein complexes or by utilizing methods analogous to those used in CRISPR-Cas9 systems (See, e.g., DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013)), incorporated herein by reference. The targeting may be of about 100 or more sequences. The targeting may be of about 1000 or more sequences. The targeting may be of about 20,000 or more sequences. The targeting may be of the entire genome. The targeting may be of a panel of target sequences focused on a relevant or desirable pathway. The pathway may be an immune pathway. The pathway may be a cell division pathway.

One aspect of the invention comprehends a genome wide library that may comprise a plurality of Cpf1 guide RNAs that may comprise guide sequences that are capable of targeting a plurality of target sequences in a plurality of genomic loci, wherein said targeting results in a knockout of gene function. This library may potentially comprise guide RNAs that target each and every gene in the genome of an organism.

In some embodiments of the invention the organism or subject is a eukaryote (including mammal including human) or a non-human eukaryote or a non-human animal or a non-human mammal. In some embodiments, the organism or subject is a non-human animal, and may be an arthropod, for example, an insect, or may be a nematode. In some methods of the invention the organism or subject is a plant. In some methods of the invention the organism or subject is a mammal or a non-human mammal. A non-human mammal may be for example a rodent (preferably a mouse or a rat), an ungulate, or a primate. In some methods of the invention the organism or subject is algae, including microalgae, or is a fungus.

The knockout of gene function may comprise: introducing into each cell in the population of cells a vector system of one or more vectors comprising an engineered, non-naturally occurring Cpf1 effector protein system comprising I. a Cpf1 effector protein, and II. one or more guide RNAs, wherein components I and II may be same or on different vectors of the system, integrating components I and II into each cell, wherein the guide sequence targets a unique gene in each cell, wherein the Cpf1 effector protein is operably linked to a regulatory element, wherein when transcribed, the guide RNA comprising the guide sequence directs sequence-specific binding of the Cpf1 effector protein system to a target sequence in the genomic loci of the unique gene, inducing cleavage of the genomic loci by the Cpf1 effector protein, and confirming different knockout mutations in a plurality of unique genes in each cell of the population of cells thereby generating a gene knockout cell library. The invention comprehends that the population of cells is a population of eukaryotic cells, and in a preferred embodiment, the population of cells is a population of embryonic stem (ES) cells.

The one or more vectors may be plasmid vectors. The vector may be a single vector comprising a Cpf1 effector protein, a gRNA, and optionally, a selection marker into target cells. Not being bound by a theory, the ability to simultaneously deliver a Cpf1 effector protein and gRNA through a single vector enables application to any cell type of interest, without the need to first generate cell lines that express the Cpf1 effector protein. The regulatory element may be an inducible promoter. The inducible promoter may be a doxycycline inducible promoter. In some methods of the invention the expression of the guide sequence is under the control of the T7 promoter and is driven by the expression of T7 polymerase. The confirming of different knockout mutations may be by whole exome sequencing. The knockout mutation may be achieved in 100 or more unique genes. The knockout mutation may be achieved in 1000 or more unique genes. The knockout mutation may be achieved in 20,000 or more unique genes. The knockout mutation may be achieved in the entire genome. The knockout of gene function may be achieved in a plurality of unique genes which function in a particular physiological pathway or condition. The pathway or condition may be an immune pathway or condition. The pathway or condition may be a cell division pathway or condition.

The invention also provides kits that comprise the genome wide libraries mentioned herein. The kit may comprise a single container comprising vectors or plasmids comprising the library of the invention. The kit may also comprise a panel comprising a selection of unique Cpf1 effector protein system guide RNAs comprising guide sequences from the library of the invention, wherein the selection is indicative of a particular physiological condition. The invention comprehends that the targeting is of about 100 or more sequences, about 1000 or more sequences or about 20,000 or more sequences or the entire genome. Furthermore, a panel of target sequences may be focused on a relevant or desirable pathway, such as an immune pathway or cell division.

In an additional aspect of the invention, the Cpf1 effector protein may comprise one or more mutations and may be used as a generic DNA binding protein with or without fusion to a functional domain. The mutations may be artificially introduced mutations or gain- or loss-of-function mutations. The mutations have been characterized as described herein. In one aspect of the invention, the functional domain may be a transcriptional activation domain, which may be VP64. In other aspects of the invention, the functional domain may be a transcriptional repressor domain, which may be KRAB or SID4X. Other aspects of the invention relate to the mutated Cpf1 effector protein being fused to domains which include but are not limited to a transcriptional activator, repressor, a recombinase, a transposase, a histone remodeler, a demethylase, a DNA methyltransferase, a cryptochrome, a light inducible/controllable domain or a chemically inducible/controllable domain. Some methods of the invention can include inducing expression of targeted genes. In one embodiment, inducing expression by targeting a plurality of target sequences in a plurality of genomic loci in a population of eukaryotic cells is by use of a functional domain.

Useful in the practice of the instant invention utilizing Cpf1 effector protein complexes are methods used in CRISPR-Cas9 systems and reference is made to:

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013). [Epub ahead of print]; Published in final edited form as: Science. 2014 Jan. 3; 343(6166): 84-87.

Shalem et al. involves a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hitsNF2, CUL3, TADA2B, and TADA1. The authors observed a high level of consistency between independent guide RNAs targeting the same gene and a high rate of hit confirmation, and thus demonstrated the promise of genome-scale screening with Cas9.

Reference is also made to US patent publication number US20140357530; and PCT Patent Publication WO2014093701, hereby incorporated herein by reference. Reference is also made to NIH Press Release of Oct. 22, 2015 entitled, "Researchers identify potential alternative to CRISPR-Cas genome editing tools: New Cas enzymes shed light on evolution of CRISPR-Cas systems, which is incorporated by reference.

Functional Alteration and Screening

In another aspect, the present invention provides for a method of functional evaluation and screening of genes. The use of the CRISPR system of the present invention to precisely deliver functional domains, to activate or repress genes or to alter epigenetic state by precisely altering the methylation site on a specific locus of interest, can be with one or more guide RNAs applied to a single cell or population of cells or with a library applied to genome in a pool of cells ex vivo or in vivo comprising the administration or expression of a library comprising a plurality of guide RNAs (gRNAs) and wherein the screening further comprises use of a Cpf1 effector protein, wherein the CRISPR complex comprising the Cpf1 effector protein is modified to comprise a heterologous functional domain. In an aspect the invention provides a method for screening a genome comprising the administration to a host or expression in a host in vivo of a library. In an aspect the invention provides a method as herein discussed further comprising an activator administered to the host or expressed in the host. In an aspect the invention provides a method as herein discussed wherein the activator is attached to a Cpf1 effector protein. In an aspect the invention provides a method as herein discussed wherein the activator is attached to the N terminus or the C terminus of the Cpf1 effector protein. In an aspect the invention provides a method as herein discussed wherein the activator is attached to a gRNA loop. In an aspect the invention provides a method as herein discussed further comprising a repressor administered to the host or expressed in the host. In an aspect the invention provides a method as herein discussed, wherein the screening comprises affecting and detecting gene activation, gene inhibition, or cleavage in the locus.

In an aspect, the invention provides efficient on-target activity and minimizes off target activity. In an aspect, the invention provides efficient on-target cleavage by Cpf1 effector protein and minimizes off-target cleavage by the Cpf1 effector protein. In an aspect, the invention provides guide specific binding of Cpf1 effector protein at a gene locus without DNA cleavage. Accordingly, in an aspect, the invention provides target-specific gene regulation. In an aspect, the invention provides guide specific binding of Cpf1 effector protein at a gene locus without DNA cleavage. Accordingly, in an aspect, the invention provides for cleavage at one gene locus and gene regulation at a different gene locus using a single Cpf1 effector protein. In an aspect, the invention provides orthogonal activation and/or inhibition and/or cleavage of multiple targets using one or more Cpf1 effector protein and/or enzyme.

An aspect the invention provides a method as herein discussed comprising the delivery of the Cpf1 effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein discussed wherein the expressing in vivo is via a lentivirus, an adenovirus, or an AAV. In an aspect the invention provides a method as herein discussed wherein the delivery is via a particle, a nanoparticle, a lipid or a cell penetrating peptide (CPP).

In an aspect the invention provides a pair of CRISPR complexes comprising Cpf1 effector protein, each comprising a guide RNA (gRNA) comprising a guide sequence capable of hybridizing to a target sequence in a genomic locus of interest in a cell, wherein at least one loop of each gRNA is modified by the insertion of distinct RNA sequence(s) that bind to one or more adaptor proteins, and wherein the adaptor protein is associated with one or more functional domains, wherein each gRNA of each Cpf1 effector protein complex comprises a functional domain having a DNA cleavage activity. In an aspect the invention provides paired Cpf1 effector protein complexes as herein-discussed, wherein the DNA cleavage activity is due to a Fok1 nuclease.

In an aspect the invention provides a method for cutting a target sequence in a genomic locus of interest comprising delivery to a cell of the Cpf1 effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein-discussed wherein the delivery is via a lentivirus, an adenovirus, or an AAV. In an aspect the invention provides a method as herein-discussed or paired Cpf1 effector protein complexes as herein-discussed wherein the target sequence for a first complex of the pair is on a first strand of double stranded DNA and the target sequence for a second complex of the pair is on a second strand of double stranded DNA. In an aspect the invention provides a method as herein-discussed or paired Cpf1 effector protein complexes as herein-discussed wherein the target sequences of the first and second complexes are in proximity to each other such that the DNA is cut in a manner that facilitates homology directed repair. In an aspect a herein method can further include introducing into the cell template DNA. In an aspect a herein method or herein paired Cpf1 effector protein complexes can involve wherein each Cpf1 effector protein complex has a Cpf1 effector enzyme that is mutated such that it has no more than about 5% of the nuclease activity of the Cpf1 effector enzyme that is not mutated. In an aspect the invention provides a library, method or complex as herein-discussed wherein the gRNA is modified to have at least one non-coding functional loop, e.g., wherein the at least one non-coding functional loop is repressive; for instance, wherein the at least one non-coding functional loop comprises Alu.

In one aspect, the invention provides a method for altering or modifying expression of a gene product. The said method may comprise introducing into a cell containing and expressing a DNA molecule encoding the gene product an engineered, non-naturally occurring CRISPR system comprising a Cpf1 effector protein and guide RNA that targets the DNA molecule, whereby the guide RNA targets the DNA molecule encoding the gene product and the Cpf1 effector protein cleaves the DNA molecule encoding the gene product, whereby expression of the gene product is altered; and, wherein the Cpf1 effector protein and the guide RNA do not naturally occur together. The invention comprehends the guide RNA comprising a guide sequence linked to a direct repeat sequence.

In some embodiments, one or more functional domains are associated with the Cpf1 effector protein. In some embodiments, one or more functional domains are associated with an adaptor protein, for example as used with the modified guides of Konnerman et al. (Nature 517, 583-588, 29 Jan. 2015). In some embodiments, one or more functional domains are associated with an dead gRNA (dRNA). In some embodiments, a dRNA complex with active Cpf1 effector protein directs gene regulation by a functional domain at on gene locus while an gRNA directs DNA cleavage by the active Cpf1 effector protein at another locus, for example as described analogously in CRISPR-Cas9 systems by Dahlman et al., 'Orthogonal gene control with a catalytically active Cas9 nuclease' (in press). In some embodiments, dRNAs are selected to maximize selectivity of regulation for a gene locus of interest compared to off-target regulation. In some embodiments, dRNAs are selected to maximize target gene regulation and minimize target cleavage For the purposes of the following discussion, reference to a functional domain could be a functional domain associated with the Cpf1 effector protein or a functional domain associated with the adaptor protein.

In the practice of the invention, loops of the gRNA may be extended, without colliding with the Cpf1 protein by the insertion of distinct RNA loop(s) or distinct sequence(s) that may recruit adaptor proteins that can bind to the distinct RNA loop(s) or distinct sequence(s). The adaptor proteins may include but are not limited to orthogonal RNA-binding protein/aptamer combinations that exist within the diversity of bacteriophage coat proteins. A list of such coat proteins includes, but is not limited to: Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. These adaptor proteins or orthogonal RNA binding proteins can further recruit effector proteins or fusions which comprise one or more functional domains. In some embodiments, the functional domain may be selected from the group consisting of: transposase domain, integrase domain, recombinase domain, resolvase domain, invertase domain, protease domain, DNA methyltransferase domain, DNA hydroxylmethylase domain, DNA demethylase domain, histone acetylase domain, histone deacetylases domain, nuclease domain, repressor domain, activator domain, nuclear-localization signal domains, transcription-regulatory protein (or transcription complex recruiting) domain, cellular uptake activity associated domain, nucleic acid binding domain, antibody presentation domain, histone modifying enzymes, recruiter of histone modifying enzymes; inhibitor of histone modifying enzymes, histone methyltransferase, histone demethylase, histone kinase, histone phosphatase, histone ribosylase, histone deribosylase, histone ubiquitinase, histone deubiquitinase, histone biotinase and histone tail protease. In some preferred embodiments, the functional domain is a transcriptional activation domain, such as, without limitation, VP64, p65, MyoD1, HSF1, RTA, SET7/9 or a histone acetyltransferase. In some embodiments, the functional domain is a transcription repression domain, preferably KRAB. In some embodiments, the transcription repression domain is SID, or concatemers of SID (eg SID4X). In some embodiments, the functional domain is an epigenetic modifying domain, such that an epigenetic modifying enzyme is provided. In some embodiments, the functional domain is an activation domain, which may be the P65 activation domain.

In some embodiments, the one or more functional domains is an NLS (Nuclear Localization Sequence) or an NES (Nuclear Export Signal). In some embodiments, the one or more functional domains is a transcriptional activation domain comprises VP64, p65, MyoD1, HSF1, RTA, SET7/9 and a histone acetyltransferase. Other references herein to activation (or activator) domains in respect of those associated with the CRISPR enzyme include any known transcriptional activation domain and specifically VP64, p65, MyoD1, HSF1, RTA, SET7/9 or a histone acetyltransferase.

In some embodiments, the one or more functional domains is a transcriptional repressor domain. In some embodiments, the transcriptional repressor domain is a KRAB domain. In some embodiments, the transcriptional repressor domain is a NuE domain, NcoR domain, SID domain or a SID4X domain.

In some embodiments, the one or more functional domains have one or more activities comprising methylase activity, demethylase activity, transcription activation activity, transcription repression activity, transcription release factor activity, histone modification activity, RNA cleavage activity, DNA cleavage activity, DNA integration activity or nucleic acid binding activity.

Histone modifying domains are also preferred in some embodiments. Exemplary histone modifying domains are discussed below. Transposase domains, HR (Homologous Recombination) machinery domains, recombinase domains, and/or integrase domains are also preferred as the present functional domains. In some embodiments, DNA integration activity includes HR machinery domains, integrase domains, recombinase domains and/or transposase domains. Histone acetyltransferases are preferred in some embodiments.

In some embodiments, the DNA cleavage activity is due to a nuclease. In some embodiments, the nuclease comprises a Fok1 nuclease. See, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In some embodiments, the one or more functional domains is attached to the Cpf1 effector protein so that upon binding to the sgRNA and target the functional domain is in a spatial orientation allowing for the functional domain to function in its attributed function.

In some embodiments, the one or more functional domains is attached to the adaptor protein so that upon binding of the Cpf1 effector protein to the gRNA and target, the functional domain is in a spatial orientation allowing for the functional domain to function in its attributed function.

In an aspect the invention provides a composition as herein discussed wherein the one or more functional domains is attached to the Cpf1 effector protein or adaptor protein via a linker, optionally a GlySer linker, as discussed herein.

Endogenous transcriptional repression is often mediated by chromatin modifying enzymes such as histone methyltransferases (HMTs) and deacetylases (HDACs). Repressive histone effector domains are known and an exemplary list is provided below. In the exemplary table, preference was given to proteins and functional truncations of small size to facilitate efficient viral packaging (for instance via AAV). In general, however, the domains may include HDACs, histone methyltransferases (HMTs), and histone acetyltransferase (HAT) inhibitors, as well as HDAC and HMT recruiting proteins. The functional domain may be or include, in some embodiments, HDAC Effector Domains, HDAC Recruiter Effector Domains, Histone Methyltransferase (HMT) Effector Domains, Histone Methyltransferase (HMT) Recruiter Effector Domains, or Histone Acetyltransferase Inhibitor Effector Domains.

TABLE

HDAC Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| HDAC I | HDAC8 | — | — | X. laevis | 325 | 1-325 | 325 | 1-272: HDAC |
| HDAC I | RPD3 | — | — | S. cerevisiae | 433 | 19-340 (Vannier) | 322 | 19-331: HDAC |
| HDAC IV | MesoLo4 | — | — | M. loti | 300 | 1-300 (Gregoretti) | 300 | — |
| HDAC IV | HDAC11 | — | — | H. sapiens | 347 | 1-347 (Gao) | 347 | 14-326: HDAC |
| HD2 | HDT1 | — | — | A. thaliana | 245 | 1-211 (Wu) | 211 | — |
| SIRT I | SIRT3 | H3K9Ac H4K16Ac H3K56Ac | — | H. sapiens | 399 | 143-399 (Scher) | 257 | 126-382: SIRT |
| SIRT I | HST2 | — | — | C. albicans | 331 | 1-331 (Hnisz) | 331 | — |
| SIRT I | CobB | — | — | E. coli (K12) | 242 | 1-242 (Landry) | 242 | — |
| SIRT I | HST2 | — | — | S. cerevisiae | 357 | 8-298 (Wilson) | 291 | — |
| SIRT III | SIRT5 | H4K8Ac H4K16Ac | — | H. sapiens | 310 | 37-310 (Gertz) | 274 | 41-309: SIRT |
| SIRT III | Sir2A | — | — | P. falciparum | 273 | 1-273 (Zhu) | 273 | 19-273: SIRT |
| SIRT IV | SIRT6 | H3K9Ac H3K56Ac | — | H. sapiens | 355 | 1-289 (Tennen) | 289 | 35-274: SIRT |

Accordingly, the repressor domains of the present invention may be selected from histone methyltransferases (HMTs), histone deacetylases (HDACs), histone acetyltransferase (HAT) inhibitors, as well as HDAC and HMT recruiting proteins.

The HDAC domain may be any of those in the table above, namely: HDAC8, RPD3, MesoLo4, HDAC11, HDT1, SIRT3, HST2, CobB, HST2, SIRT5, Sir2A, or SIRT6.

In some embodiment, the functional domain may be a HDAC Recruiter Effector Domain. Preferred examples include those in the Table below, namely MeCP2, MBD2b, Sin3a, NcoR, SALL1, RCOR1. NcoR is exemplified in the present Examples and, although preferred, it is envisaged that others in the class will also be useful.

TABLE

HDAC Recruiter Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| Sin3a | MeCP2 | — | — | R. norvegicus | 492 | 207-492 (Nan) | 286 | — |
| Sin3a | MBD2b | — | — | H. sapiens | 262 | 45-262 (Boeke) | 218 | — |
| Sin3a | Sin3a | — | — | H. sapiens | 1273 | 524-851 (Laherty) | 328 | 627-829: HDAC1 interaction |
| NcoR | NcoR | — | — | H. sapiens | 2440 | 420-488 (Zhang) | 69 | — |
| NuRD | SALL1 | — | — | M. musculus | 1322 | 1-93 (Lauberth) | 93 | — |
| CoREST | RCOR1 | — | — | H. sapiens | 482 | 81-300 (Gu, Ouyang) | 220 | — |

In some embodiment, the functional domain may be a Methyltransferase (HMT) Effector Domain. Preferred examples include those in the Table below, namely NUE, vSET, EHMT2/G9A, SUV39H11, dim-5, KYP, SUVR4, SET4, SET1, SETD8, and TgSET8. NUE is exemplified in the present Examples and, although preferred, it is envisaged that others in the class will also be useful.

TABLE

Histone Methyltransferase (HMT) Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| SET | NUE | H2B, H3, H4 | — | C. trachomatis | 219 | 1-219 (Pennini) | 219 | — |
| SET | vSET | — | H3K27me3 | P. bursaria chlorella virus | 119 | 1-119 (Mujtaba) | 119 | 4-112: SET2 |
| SUV39 family | EHMT2/ G9A | H1.4K2, H3K9, H3K27 | H3K9me1/2, H1K25me1 | M. musculus | 1263 | 969-1263 (Tachibana) | 295 | 1025-1233: preSET, SET, postSET |
| SUV39 | SUV39 H1 | — | H3K9me2/3 | H. sapiens | 412 | 79-412 (Snowden) | 334 | 172-412: preSET, SET, postSET |
| Suvar3-9 | dim-5 | — | H3K9me3 | N. crassa | 331 | 1-331 (Rathert) | 331 | 77-331: preSET, SET, postSET |
| Suvar3-9 (SUVH subfamily) | KYP | — | H3K9me1/2 | A. thaliana | 624 | 335-601 | 267 (Jackson) | — |
| Suvar3-9 (SUVR subfamily) | SUVR4 | H3K9me1 | H3K9me2/3 | A. thaliana | 492 | 180-492 | 313 (Thorstensen) | 192-462: preSET, SET, postSET |
| Suvar4-20 | SET4 | — | H4K20me3 | C. elegans | 288 | 1-288 (Vielle) | 288 | — |
| SET8 | SET1 | — | H4K20me1 | C. elegans | 242 | 1-242 (Vielle) | 242 | — |
| SET8 | SETD8 | — | H4K20me1 | H. sapiens | 393 | 185-393 | 209 (Couture) | 256-382: SET |
| SET8 | TgSET8 | — | H4K20me1/2/3 | T. gondii | 1893 | 1590-1893 (Sautel) | 304 | 1749-1884: SET |

In some embodiment, the functional domain may be a Histone Methyltransferase (HMT) Recruiter Effector Domain. Preferred examples include those in the Table below, namely Hp1a, PHF19, and NIPP1.

TABLE

Histone Methyltransferase (HMT) Recruiter Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| — | Hp1a | — | H3K9me3 | M. musculus | 191 | 73-191 | 119 (Hathaway) | 121-179: chromoshadow |
| — | PHF19 | — | H3K27me3 | H. sapiens | 580 | (1-250) + GGSG linker + (500-580) | 335 (Ballare) | 163-250: PHD2 |
| — | NIPP1 | — | H3K27me3 | H. sapiens | 351 | 1-329 (Jin) | 329 | 310-329: EED |

In some embodiment, the functional domain may be Histone Acetyltransferase Inhibitor Effector Domain. Preferred examples include SET/TAF-1β listed in the Table below.

TABLE

Histone Acetyltransferase Inhibitor Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| — | SET/TAF-1β | — | — | M. musculus | 289 | 1-289 (Cervoni) | 289 | — |

It is also preferred to target endogenous (regulatory) control elements (such as enhancers and silencers) in addition to a promoter or promoter-proximal elements. Thus, the invention can also be used to target endogenous control elements (including enhancers and silencers) in addition to targeting of the promoter. These control elements can be located upstream and downstream of the transcriptional start site (TSS), starting from 200 bp from the TSS to 100 kb away. Targeting of known control elements can be used to activate or repress the gene of interest. In some cases, a single control element can influence the transcription of multiple target genes. Targeting of a single control element could therefore be used to control the transcription of multiple genes simultaneously.

Targeting of putative control elements on the other hand (e.g. by tiling the region of the putative control element as well as 200 bp up to 100 kB around the element) can be used as a means to verify such elements (by measuring the transcription of the gene of interest) or to detect novel control elements (e.g. by tiling 100 kb upstream and downstream of the TSS of the gene of interest). In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNAseq or microarray. This would allow for the identification of likely candidate genes involved in the disease phenotype. Such candidate genes could be useful as novel drug targets.

Histone acetyltransferase (HAT) inhibitors are mentioned herein. However, an alternative in some embodiments is for the one or more functional domains to comprise an acetyltransferase, preferably a histone acetyltransferase. These are useful in the field of epigenomics, for example in methods of interrogating the epigenome. Methods of interrogating the epigenome may include, for example, targeting epigenomic sequences. Targeting epigenomic sequences may include the guide being directed to an epigenomic target sequence. Epigenomic target sequence may include, in some embodiments, include a promoter, silencer or an enhancer sequence.

Use of a functional domain linked to a Cpf1 effector protein as described herein, preferably a dead-Cpf1 effector protein, more preferably a dead-FnCpf1 effector protein, to target epigenomic sequences can be used to activate or repress promoters, silencer or enhancers.

Examples of acetyltransferases are known but may include, in some embodiments, histone acetyltransferases. In some embodiments, the histone acetyltransferase may comprise the catalytic core of the human acetyltransferase p300 (Gerbasch & Reddy, Nature Biotech 6 Apr. 2015).

In some preferred embodiments, the functional domain is linked to a dead-Cpf1 effector protein to target and activate epigenomic sequences such as promoters or enhancers. One or more guides directed to such promoters or enhancers may also be provided to direct the binding of the CRISPR enzyme to such promoters or enhancers.

The term "associated with" is used here in relation to the association of the functional domain to the Cpf1 effector protein or the adaptor protein. It is used in respect of how one molecule 'associates' with respect to another, for example between an adaptor protein and a functional domain, or between the Cpf1 effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the Cpf1 effector protein or adaptor protein is associated with a functional domain by binding thereto. In other embodiments, the Cpf1 effector protein or adaptor protein is associated with a functional domain because the two are fused together, optionally via an intermediate linker.

Attachment of a functional domain or fusion protein can be via a linker, e.g., a flexible glycine-serine (GlyGlyGly-Ser) (SEQ ID NO: 18) or (GGGS)$_3$ (SEQ ID NO: 797) or a rigid alpha-helical linker such as (Ala(GluAlaAlaAlaLys)Ala) (SEQ ID NO: 798). Linkers such as (GGGGS)$_3$ (SEQ ID NO: 19) are preferably used herein to separate protein or peptide domains. (GGGGS)$_3$ (SEQ ID NO: 19) is preferable because it is a relatively long linker (15 amino acids). The glycine residues are the most flexible and the serine residues enhance the chance that the linker is on the outside of the protein. (GGGGS)$_6$ (SEQ ID NO: 20), (GGGGS)$_9$ (SEQ ID NO: 21) or (GGGGS)$_{12}$ (SEQ ID NO: 22) may preferably be used as alternatives. Other preferred alternatives are (GGGGS)$_1$ (SEQ ID NO: 789), (GGGGS)$_2$ (SEQ ID NO: 790), (GGGGS)$_4$ (SEQ ID NO: 791), (GGGGS)$_5$ (SEQ ID NO: 792), (GGGGS)$_7$ (SEQ ID NO: 793), (GGGGS)$_8$ (SEQ ID NO: 794), (GGGGS)$_{10}$ (SEQ ID NO: 795), or (GGGGS)$_{11}$ (SEQ ID NO: 796). Alternative linkers are available, but highly flexible linkers are thought to work best to allow for maximum opportunity for the 2 parts of the Cpf1 to come together and thus reconstitute Cpf1 activity. One alternative is that the NLS of nucleoplasmin can be used as a linker. For example, a linker can also be used between the Cpf1 and any functional domain. Again, a (GGGGS)$_3$ (SEQ ID NO: 19) linker may be used here (or the 6 (SEQ ID NO: 20), 9 (SEQ ID NO: 21), or 12 (SEQ ID NO: 22) repeat versions therefore) or the NLS of nucleoplasmin can be used as a linker between Cpf1 and the functional domain.

Saturating Mutagenesis

The Cpf1 effector protein system(s) described herein can be used to perform saturating or deep scanning mutagenesis of genomic loci in conjunction with a cellular phenotype—for instance, for determining critical minimal features and discrete vulnerabilities of functional elements required for gene expression, drug resistance, and reversal of disease. By saturating or deep scanning mutagenesis is meant that every or essentially every DNA base is cut within the genomic loci. A library of Cpf1 effector protein guide RNAs may be introduced into a population of cells. The library may be introduced, such that each cell receives a single guide RNA (gRNA). In the case where the library is introduced by transduction of a viral vector, as described herein, a low multiplicity of infection (MOI) is used. The library may include gRNAs targeting every sequence upstream of a (protospacer adjacent motif) (PAM) sequence in a genomic locus. The library may include at least 100 non-overlapping genomic sequences upstream of a PAM sequence for every 1000 base pairs within the genomic locus. The library may include gRNAs targeting sequences upstream of at least one different PAM sequence. The Cpf1 effector protein systems may include more than one Cpf1 protein. Any Cpf1 effector protein as described herein, including orthologues or engineered Cpf1 effector proteins that recognize different PAM sequences may be used. The frequency of off target sites for a gRNA may be less than 500. Off target scores may be generated to select gRNAs with the lowest off target sites. Any phenotype determined to be associated with cutting at a gRNA target site may be confirmed by using gRNAs targeting the same site in a single experiment. Validation of a target site may also be performed by using a modified Cpf1 effector protein, as described herein, and two gRNAs targeting the genomic site of interest. Not being bound by a theory, a target site is a true hit if the change in phenotype is observed in validation experiments.

The genomic loci may include at least one continuous genomic region. The at least one continuous genomic region may comprise up to the entire genome. The at least one continuous genomic region may comprise a functional element of the genome. The functional element may be within a non-coding region, coding gene, intronic region, promoter, or enhancer. The at least one continuous genomic region may comprise at least 1 kb, preferably at least 50 kb of genomic DNA. The at least one continuous genomic region may comprise a transcription factor binding site. The at least one continuous genomic region may comprise a region of DNase I hypersensitivity. The at least one continuous genomic region may comprise a transcription enhancer or repressor element. The at least one continuous genomic region may comprise a site enriched for an epigenetic signature. The at least one continuous genomic DNA region may comprise an epigenetic insulator. The at least one continuous genomic region may comprise two or more continuous genomic regions that physically interact. Genomic regions that interact may be determined by '4C technology'. 4C technology allows the screening of the entire genome in an unbiased manner for DNA segments that physically interact with a DNA fragment of choice, as is described in Zhao et al. ((2006) Nat Genet 38, 1341-7) and in U.S. Pat. No. 8,642,295, both incorporated herein by reference in its entirety. The epigenetic signature may be histone acetylation, histone methylation, histone ubiquitination, histone phosphorylation, DNA methylation, or a lack thereof.

The Cpf1 effector protein system(s) for saturating or deep scanning mutagenesis can be used in a population of cells. The Cpf1 effector protein system(s) can be used in eukaryotic cells, including but not limited to mammalian and plant cells. The population of cells may be prokaryotic cells. The population of eukaryotic cells may be a population of embryonic stem (ES) cells, neuronal cells, epithelial cells, immune cells, endocrine cells, muscle cells, erythrocytes, lymphocytes, plant cells, or yeast cells.

In one aspect, the present invention provides for a method of screening for functional elements associated with a change in a phenotype. The library may be introduced into a population of cells that are adapted to contain a Cpf1 effector protein. The cells may be sorted into at least two groups based on the phenotype. The phenotype may be expression of a gene, cell growth, or cell viability. The relative representation of the guide RNAs present in each group are determined, whereby genomic sites associated with the change in phenotype are determined by the representation of guide RNAs present in each group. The change in phenotype may be a change in expression of a gene of interest. The gene of interest may be upregulated, downregulated, or knocked out. The cells may be sorted into a high expression group and a low expression group. The population of cells may include a reporter construct that is used to determine the phenotype. The reporter construct may include a detectable marker. Cells may be sorted by use of the detectable marker.

In another aspect, the present invention provides for a method of screening for genomic sites associated with resistance to a chemical compound. The chemical compound may be a drug or pesticide. The library may be introduced into a population of cells that are adapted to contain a Cpf1 effector protein, wherein each cell of the population contains no more than one guide RNA; the population of cells are treated with the chemical compound; and the representation of guide RNAs are determined after treatment with the chemical compound at a later time point as compared to an early time point, whereby genomic sites associated with resistance to the chemical compound are determined by enrichment of guide RNAs. Representation of gRNAs may be determined by deep sequencing methods.

Useful in the practice of the instant invention utilizing Cpf1 effector protein complexes are methods used in CRISPR-Cas9 systems and reference is made to the article entitled BCL11A enhancer dissection by Cas9-mediated in situ saturating mutagenesis. Canver, M. C., Smith, E. C., Sher, F., Pinello, L., Sanjana, N. E., Shalem, O., Chen, D. D., Schupp, P. G., Vinjamur, D. S., Garcia, S. P., Luc, S., Kurita, R., Nakamura, Y., Fujiwara, Y., Maeda, T., Yuan, G., Zhang, F., Orkin, S. H., & Bauer, D. E. DOI:10.1038/nature15521, published online Sep. 16, 2015, the article is herein incorporated by reference and discussed briefly below:

Canver et al. involves novel pooled CRISPR-Cas9 guide RNA libraries to perform in situ saturating mutagenesis of the human and mouse BCL11A erythroid enhancers previously identified as an enhancer associated with fetal hemoglobin (HbF) level and whose mouse ortholog is necessary for erythroid BCL11A expression. This approach revealed critical minimal features and discrete vulnerabilities of these enhancers. Through editing of primary human progenitors and mouse transgenesis, the authors validated the BCL11A erythroid enhancer as a target for HbF reinduction. The authors generated a detailed enhancer map that informs therapeutic genome editing.

Method of Using Cpf1 Systems to Modify a Cell or Organism

The invention in some embodiments comprehends a method of modifying an cell or organism. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced. Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV.

In another embodiment, Cocal vesiculovirus envelope pseudotyped retroviral vector particles are contemplated (see, e.g., US Patent Publication No. 20120164118 assigned to the Fred Hutchinson Cancer Research Center). Cocal virus is in the Vesiculovirus genus, and is a causative agent of vesicular stomatitis in mammals. Cocal virus was originally isolated from mites in Trinidad (Jonkers et al., Am. J. Vet. Res. 25:236-242 (1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242 (1964) and Travassos da Rosa et al., Am. J. Tropical Med. & Hygiene 33:999-1006 (1984). The Cocal vesiculovirus envelope pseudotyped retroviral vector particles may include for example, lentiviral, alpharetroviral, betaretroviral, gammaretroviral, deltaretroviral, and epsilon-retroviral vector particles that may comprise retroviral Gag, Pol, and/or one or more accessory protein(s) and a Cocal vesiculovirus envelope protein. Within certain aspects of these embodiments, the Gag, Pol, and accessory proteins are lentiviral and/or gammaretroviral. The invention provides AAV that contains or consists essentially of an exogenous nucleic acid molecule encoding a CRISPR system, e.g., a plurality of cassettes comprising or consisting a first cassette comprising or consisting essentially of a promoter, a nucleic acid molecule encoding a CRISPR-associated (Cas) protein (putative nuclease or helicase proteins), e.g., Cpf1 and a terminator, and a two, or more, advantageously up to the packaging size limit of the vector, e.g., in total (including the first cassette) five, cassettes comprising or consisting essentially of a promoter, nucleic acid molecule encoding guide RNA (gRNA) and a terminator (e.g., each cassette schematically represented as Promoter-gRNAI-terminator, Promoter-gRNA2-terminator . . . Promoter-gRNA(N)-terminator (where N is a number that can be inserted that is at an upper limit of the packaging size limit of the vector), or two or more individual rAAVs, each containing one or more than one cassette of a CRISPR system, e.g., a first rAAV containing the first cassette comprising or consisting essentially of a promoter, a nucleic acid molecule encoding Cas, e.g., Cas (Cpf1) and a terminator, and a second rAAV containing a plurality, four, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator (where N is a number that can be inserted that is at an upper limit of the packaging size limit of the vector). As rAAV is a DNA virus, the nucleic acid molecules in the herein discussion concerning AAV or rAAV are advantageously DNA. The promoter is in some embodiments advantageously human Synapsin I promoter (hSyn). Additional methods for the delivery of nucleic acids to cells are known to those skilled in the art. See, for example, US20030087817, incorporated herein by reference.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr -/-, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a non-human transgenic animal or transgenic plant. In some embodiments, the transgenic animal is a mammal, such as a mouse, rat, or rabbit. Methods for producing transgenic animals and plants are known in the art, and generally begin with a method of cell transfection, such as described herein. In another embodiment, a fluid delivery device with an array of needles (see, e.g., US Patent Publication No. 20110230839 assigned to the Fred Hutchinson Cancer Research Center) may be contemplated for delivery of CRISPR Cas to solid tissue. A device of US Patent Publication No. 20110230839 for delivery of a fluid to a solid tissue may comprise a plurality of needles arranged in an array; a plurality of reservoirs, each in fluid communication with a respective one of the plurality of needles; and a plurality of actuators operatively coupled to respective ones of the plurality of reservoirs and configured to control a fluid pressure within the reservoir. In certain embodiments each of the plurality of actuators may comprise one of a plurality of plungers, a first end of each of the plurality of plungers being received in a respective one of the plurality of reservoirs, and in certain further embodiments the plungers of the plurality of plungers are operatively coupled together at respective second ends so as to be simultaneously depressable. Certain still further embodiments may comprise a plunger driver configured to depress all of the plurality of plungers at a selectively variable rate. In other embodiments each of the plurality of actuators may comprise one of a plurality of fluid transmission lines having first and second ends, a first end of each of the plurality of fluid transmission lines being coupled to a respective one of the plurality of reservoirs. In other embodiments the device may comprise a fluid pressure source, and each of the plurality of actuators comprises a fluid coupling between the fluid pressure source and a respective one of the plurality of reservoirs. In further embodiments the fluid pressure source may comprise at least one of a compressor, a vacuum accumulator, a peristaltic pump, a master cylinder, a microfluidic pump, and a valve. In another embodiment, each of the plurality of needles may comprise a plurality of ports distributed along its length.

In one aspect, the invention provides for methods of modifying a target polynucleotide in a eukaryotic cell. In some embodiments, the method comprises allowing a nucleic acid-targeting complex to bind to the target polynucleotide to effect cleavage of said target polynucleotide thereby modifying the target polynucleotide, wherein the nucleic acid-targeting complex comprises a nucleic acid-targeting effector protein complexed with a guide RNA hybridized to a target sequence within said target polynucleotide.

CRISPR complex components may be delivered by conjugation or association with transport moieties (adapted for example from approaches disclosed in U.S. Pat. Nos. 8,106,022; 8,313,772). Nucleic acid delivery strategies may for example be used to improve delivery of guide RNA, or messenger RNAs or coding DNAs encoding CRISPR complex components. For example, RNAs may incorporate modified RNA nucleotides to improve stability, reduce immunostimulation, and/or improve specificity (see Deleavey, Glen F. et al., 2012, Chemistry & Biology, Volume 19, Issue 8, 937-954; Zalipsky, 1995, Advanced Drug Delivery Reviews 16: 157-182; Caliceti and Veronese, 2003, Advanced Drug Delivery Reviews 55: 1261-1277). Various constructs have been described that may be used to modify nucleic acids, such as gRNAs, for more efficient delivery, such as reversible charge-neutralizing phosphotriester backbone modifications that may be adapted to modify gRNAs so as to be more hydrophobic and non-anionic, thereby improving cell entry (Meade B R et al., 2014, Nature Biotechnology 32, 1256-1261). In further alternative embodiments, selected RNA motifs may be useful for mediating cellular transfection (Magalhães M., et al., Molecular Therapy (2012); 20 3, 616-624). Similarly, aptamers may be adapted for delivery of CRISPR complex components, for example by appending aptamers to gRNAs (Tan W. et al., 2011, Trends in Biotechnology, December 2011, Vol. 29, No. 12).

In some embodiments, conjugation of triantennary N-acetyl galactosamine (GalNAc) to oligonucleotide components may be used to improve delivery, for example delivery to select cell types, for example hepatocytes (see WO2014118272 incorporated herein by reference; Nair, J K et al., 2014, Journal of the American Chemical Society 136 (49), 16958-16961). This may beis considered to be a sugar-based particle and further details on other particle delivery systems and/or formulations are provided herein. GalNAc can therefore be considered to be a particle in the sense of the other particles described herein, such that general uses and other considerations, for instance delivery of said particles, apply to GalNAc particles as well. A solution-phase conjugation strategy may for example be used to attach triantennary GalNAc clusters (mol. wt. ~2000) activated as PFP (pentafluorophenyl) esters onto 5'-hexylamino modified oligonucleotides (5'-HA ASOs, mol. wt. ~8000 Da; Østergaard et al., Bioconjugate Chem., 2015, 26 (8), pp 1451-1455). Similarly, poly(acrylate) polymers have been described for in vivo nucleic acid delivery (see WO2013158141 incorporated herein by reference). In further alternative embodiments, pre-mixing CRISPR nanoparticles (or protein complexes) with naturally occurring serum proteins may be used in order to improve delivery (Akinc A et al, 2010, Molecular Therapy vol. 18 no. 7, 1357-1364).

Screening techniques are available to identify delivery enhancers, for example by screening chemical libraries (Gilleron J. et al., 2015, Nucl. Acids Res. 43 (16): 7984-8001). Approaches have also been described for assessing the efficiency of delivery vehicles, such as lipid nanoparticles, which may be employed to identify effective delivery vehicles for CRISPR components (see Sahay G. et al., 2013, Nature Biotechnology 31, 653-658).

In some embodiments, delivery of protein CRISPR components may be facilitated with the addition of functional peptides to the protein, such as peptides that change protein hydrophobicity, for example so as to improve in vivo functionality. CRISPR component proteins may similarly be modified to facilitate subsequent chemical reactions. For example, amino acids may be added to a protein that have a group that undergoes click chemistry (Nikid I. et al., 2015, Nature Protocols 10, 780-791). In embodiments of this kind, the click chemical group may then be used to add a wide variety of alternative structures, such as poly(ethylene glycol) for stability, cell penetrating peptides, RNA aptamers, lipids, or carbohydrates such as GalNAc. In further alternatives, a CRISPR component protein may be modified to adapt the protein for cell entry (see Svensen et al., 2012, Trends in Pharmacological Sciences, Vol. 33, No. 4), for example by adding cell penetrating peptides to the protein (see Kauffman, W. Berkeley et al., 2015, Trends in Biochemical Sciences, Volume 40, Issue 12, 749-764; Koren and Torchilin, 2012, Trends in Molecular Medicine, Vol. 18, No. 7). In further alternative embodiment, patients or subjects may be pre-treated with compounds or formulations that facilitate the later delivery of CRISPR components.

Cpf1 Effector Protein Complexes can be Used in Plants

The Cpf1 effector protein system(s) (e.g., single or multiplexed) can be used in conjunction with recent advances in crop genomics. The systems described herein can be used to perform efficient and cost effective plant gene or genome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. The Cpf1 effector protein system(s) can be used with regard to plants in Site-Directed Integration (SDI) or Gene Editing (GE) or any Near Reverse Breeding (NRB) or Reverse Breeding (RB) techniques. Aspects of utilizing the herein described Cpf1 effector protein systems may be analogous to the use of the CRISPR-Cas (e.g. CRISPR-Cas9) system in plants, and mention is made of the University of Arizona website "CRISPR-PLANT" (worldwideweb.genome.arizona.edu/crispr/) (supported by Penn State and AGI). Embodiments of the invention can be used in genome editing in plants or where RNAi or similar genome editing techniques have been used previously; see, e.g., Nekrasov, "Plant genome editing made easy: targeted mutagenesis in model and crop plants using the CRISPR-Cas system," Plant Methods 2013, 9:39 (doi:10.1186/1746-4811-9-39); Brooks, "Efficient gene editing in tomato in the first generation using the CRISPR-Cas9 system," Plant Physiology September 2014 pp 114.247577; Shan, "Targeted genome modification of crop plants using a CRISPR-Cas system," Nature Biotechnology 31, 686-688 (2013); Feng, "Efficient genome editing in plants using a CRISPR/Cas system," Cell Research (2013) 23:1229-1232. doi: 10.1038/cr.2013.114; published online 20 Aug. 2013; Xie, "RNA-guided genome editing in plants using a CRISPR-Cas system," Mol Plant. 2013 November; 6(6):1975-83. doi: 10.1093/mp/sst119. Epub 2013 Aug. 17; Xu, "Gene targeting using the Agrobacterium tumefaciens-mediated CRISPR-Cas system in rice," Rice 2014, 7:5 (2014), Zhou et al., "Exploiting SNPs for biallelic CRISPR mutations in the outcrossing woody perennial Populus reveals 4-coumarate: CoA ligase specificity and Redundancy," New Phytologist (2015) (Forum) 1-4 (available online only at worldwideweb.newphytologist.com); Caliando et al, "Targeted DNA degradation using a CRISPR device stably carried in the host genome, NATURE COMMUNICATIONS 6:6989, DOI: 10.1038/ncomms7989, worldwideweb.nature.com/naturecommunications DOI: 10.1038/ncomms7989; U.S. Pat. No. 6,603,061—Agrobacterium-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety. In the practice of the invention, the contents and disclosure of Morrell et al "Crop genomics: advances and applications," Nat Rev Genet. 2011 Dec. 29; 13(2):85-96; each of which is incorporated by reference herein including as to how herein embodiments may be used as to plants. Accordingly, reference herein to animal cells may also apply, mutatis mutandis, to plant cells unless otherwise apparent; and, the enzymes herein having reduced off-target effects and systems employing such enzymes can be used in plant applications, including those mentioned herein.

Application of Cpf1-CRISPR System to Plants and Yeast

Definitions

In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for genome editing using the Cpf1 system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., *petunia*, rose, *chrysanthemum*), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Thus, the methods and CRISPR-Cas systems can be used over a broad range of plants, such as for example with dicotyledonous plants belonging to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales, or with plants belonging to Gymnospermae, e.g those belonging to the orders Pinales, Ginkgoales, Cycadales, Araucariales, Cupressales and Gnetales.

The Cpf1 CRISPR systems and methods of use described herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis*, and *Vigna*; and the genera *Allium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum, Zea, Abies, Cunninghamia, Ephedra, Picea, Pinus*, and *Pseudotsuga*.

The Cpf1 CRISPR systems and methods of use can also be used over a broad range of "algae" or "algae cells"; including for example algea selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Anikstrodesmis, Botryococcus, Chaetoceros, Chlamydomonas, Chlorella, Chlorococcum, Cyclotella, Cylindrotheca, Dunaliella, Emiliana, Euglena, Hematococcus, Isochrysis, Monochrysis, Monoraphidium, Nannochloris, Nannnochloropsis, Navicula, Nephrochloris, Nephroselmis, Nitzschia, Nodularia, Nostoc, Oochromonas, Oocystis, Oscillartoria, Pavlova, Phaeodactylum, Playtmonas, Pleurochrysis, Porhyra, Pseudoanabaena, Pyramimonas, Stichococcus, Synechococcus, Synechocystis, Tetraselmis, Thalassiosira*, and *Trichodesmium*.

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendents of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerervisiae, Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and Issatchenkia spp. (e.g., *Issatchenkia orientalis*, a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guideRNA may more often be a rate-limiting component in genome engineering of polyploid cells than in haploid cells, and thus the methods using the Cpf1 CRISPRS system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2µ plasmids, yeast integrative plasmids, yeast replicative plasmids, shuttle vectors, and episomal plasmids.

Stable Integration of Cpf1 CRISP System Components in the Genome of Plants and Plant Cells In particular embodiments, it is envisaged that the polynucleotides encoding the components of the Cpf1 CRISPR system are introduced for stable integration into the genome of a plant cell. In these embodiments, the design of the transformation vector or the expression system can be adjusted depending on for when, where and under what conditions the guide RNA and/or the Cpf1 gene are expressed.

In particular embodiments, it is envisaged to introduce the components of the Cpf1 CRISPR system stably into the genomic DNA of a plant cell. Additionally or alternatively, it is envisaged to introduce the components of the Cpf1 CRISPR system for stable integration into the DNA of a plant organelle such as, but not limited to a plastid, e mitochondrion or a chloroplast.

The expression system for stable integration into the genome of a plant cell may contain one or more of the following elements: a promoter element that can be used to express the RNA and/or Cpf1 enzyme in a plant cell; a 5' untranslated region to enhance expression; an intron element to further enhance expression in certain cells, such as monocot cells; a multiple-cloning site to provide convenient restriction sites for inserting the guide RNA and/or the Cpf1 gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a Cfp1 CRISPR expression system comprises at least:
- a nucleotide sequence encoding a guide RNA (gRNA) that hybridizes with a target sequence in a plant, and wherein the guide RNA comprises a guide sequence and a direct repeat sequence, and a nucleotide sequence encoding a Cpf1 protein,
- wherein components (a) or (b) are located on the same or on different constructs, and whereby the different nucleotide sequences can be under control of the same or a different regulatory element operable in a plant cell.

DNA construct(s) containing the components of the Cpf1 CRISPR system, and, where applicable, template sequence may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom.

In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene/s of interest toward cells, resulting in the penetration of the protoplasm by the particles and typically stable integration into the genome. (see e.g. Klein et al, Nature (1987), Klein et ah, Bio/Technology (1992), Casas et ah, Proc. Natl. Acad. Sci. USA (1993).).

In particular embodiments, the DNA constructs containing components of the Cpf1 CRISPR system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the Cpf1 CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the Cpf1 CRISPR components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the Cpf1 CRISPR system-are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

In particular embodiments, transient or inducible expression can be achieved by using, for example, chemical-regulated promotors, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-ll-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast Targeting

In particular embodiments, it is envisaged that the Cpf1 CRISPR system is used to specifically modify chloroplast genes or to ensure expression in the chloroplast. For this purpose use is made of chloroplast transformation methods or compartmentalization of the Cpf1 CRISPR components to the chloroplast. For instance, the introduction of genetic modifications in the plastid genome can reduce biosafety issues such as gene flow through pollen. In many cases, this targeting may be achieved by the presence of an N-terminal extension, called a chloroplast transit peptide (CTP) or plastid transit peptide. Chromosomal transgenes from bacterial sources must have a sequence encoding a CTP sequence fused to a sequence encoding an expressed polypeptide if the expressed polypeptide is to be compartmentalized in the plant plastid (e.g. chloroplast). Accordingly, localization of an exogenous polypeptide to a chloroplast is often 1 accomplished by means of operably linking a polynucleotide sequence encoding a CTP sequence to the 5' region of a polynucleotide encoding the exogenous polypeptide. The CTP is removed in a processing step during translocation into the plastid. Processing efficiency may, however, be affected by the amino acid sequence of the CTP and nearby sequences at the NH 2 terminus of the peptide. Other options for targeting to the chloroplast which have been described are the maize cab-m7 signal sequence (U.S. Pat. No. 7,022,896, WO 97/41228) a pea glutathione reductase signal sequence (WO 97/41228) and the CTP described in US2009029861.

Methods of chloroplast transformation are known in the art and include Particle bombardment, PEG treatment, and microinjection. Additionally, methods involving the translocation of transformation cassettes from the nuclear genome to the pastid can be used as described in WO2010061186.

Alternatively, it is envisaged to target one or more of the Cpf1 CRISPR components to the plant chloroplast. This is achieved by incorporating in the expression construct a sequence encoding a chloroplast transit peptide (CTP) or plastid transit peptide, operably linked to the 5' region of the sequence encoding the Cpf1 protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the guide RNA to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the Cpf1-guide RNA.

Introduction of Polynucleotides Encoding the CRISPR-Cpf1 System in Algal Cells.

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the Cpf1 CRISPR system described herein can be applied on *Chlamydomonas* species and other algae. In particular embodiments, Cpf1 and guide RNA are introduced in algae expressed using a vector that expresses Cpf1 under the control of a constitutive promoter such as Hsp70A-Rbc S2 or Beta2-tubulin. Guide RNA is optionally delivered using a vector containing T7 promoter. Alternatively, Cas9 mRNA and in vitro transcribed guide RNA can be delivered to algal cells. Electroporation protocols are available to the skilled person such as the standard recommended protocol from the GeneArt *Chlamydomonas* Engineering kit.

In particular embodiments, the endonuclease used herein is a Split Cpf1 enzyme. Split Cpf1 enzymes are preferentially used in Algae for targeted genome modification as has been described for Cas9 in WO 2015086795. Use of the Cpf1 split system is particularly suitable for an inducible method of genome targeting and avoids the potential toxic effect of the Cpf1 overexpression within the algae cell. In particular embodiments, Said Cpf1 split domains (RuvC and HNH domains) can be simultaneously or sequentially introduced into the cell such that said split Cpf1 domain(s) process the target nucleic acid sequence in the algae cell. The reduced size of the split Cpf1 compared to the wild type Cpf1 allows other methods of delivery of the CRISPR system to the cells, such as the use of Cell Penetrating Peptides as described herein. This method is of particular interest for generating genetically modified algae.

Introduction of Polynucleotides Encoding Cpf1 Components in Yeast Cells

In particular embodiments, the invention relates to the use of the Cpf1 CRISPR system for genome editing of yeast cells. Methods for transforming yeast cells which can be used to introduce polynucleotides encoding the Cpf1 CRISPR system components are well known to the artisan and are reviewed by Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation.

Transient Expression of Cpf1 CRISP System Components in Plants and Plant Cell

In particular embodiments, it is envisaged that the guide RNA and/or Cpf1 gene are transiently expressed in the plant cell. In these embodiments, the Cpf1 CRISPR system can ensure modification of a target gene only when both the guide RNA and the Cpf1 protein is present in a cell, such that genomic modification can further be controlled. As the expression of the Cpf1 enzyme is transient, plants regenerated from such plant cells typically contain no foreign DNA. In particular embodiments the Cpf1 enzyme is stably expressed by the plant cell and the guide sequence is transiently expressed.

In particular embodiments, the Cpf1 CRISPR system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors.

In particular embodiments, the vector used for transient expression of Cpf1 CRISPR constructs is for instance a pEAQ vector, which is tailored for *Agrobacterium*-mediated transient expression (Sainsbury F. et al., Plant Biotechnol J. 2009 September; 7(7):682-93) in the protoplast. Precise targeting of genomic locations was demonstrated using a modified Cabbage Leaf Curl virus (CaLCuV) vector to express gRNAs in stable transgenic plants expressing a CRISPR enzyme (Scientific Reports 5, Article number: 14926 (2015), doi:10.1038/srep14926).

In particular embodiments, double-stranded DNA fragments encoding the guide RNA and/or the Cpf1 gene can be transiently introduced into the plant cell. In such embodiments, the introduced double-stranded DNA fragments are provided in sufficient quantity to modify the cell but do not persist after a contemplated period of time has passed or after one or more cell divisions. Methods for direct DNA transfer in plants are known by the skilled artisan (see for instance Davey et al. Plant Mol Biol. 1989 September; 13(3):273-85.)

In other embodiments, an RNA polynucleotide encoding the Cpf1 protein is introduced into the plant cell, which is then translated and processed by the host cell generating the protein in sufficient quantity to modify the cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122).

Combinations of the different methods described above are also envisaged.

Delivery of Cpf1 CRISPR Components to the Plant Cell

In particular embodiments, it is of interest to deliver one or more components of the Cpf1 CRISPR system directly to the plant cell. This is of interest, inter alia, for the generation of non-transgenic plants (see below). In particular embodiments, one or more of the Cpf1 components is prepared outside the plant or plant cell and delivered to the cell. For instance in particular embodiments, the Cpf1 protein is prepared in vitro prior to introduction to the plant cell. Cpf1 protein can be prepared by various methods known by one of skill in the art and include recombinant production. After expression, the Cpf1 protein is isolated, refolded if needed, purified and optionally treated to remove any purification tags, such as a His-tag. Once crude, partially purified, or more completely purified Cpf1 protein is obtained, the protein may be introduced to the plant cell.

In particular embodiments, the Cpf1 protein is mixed with guide RNA targeting the gene of interest to form a pre-assembled ribonucleoprotein.

The individual components or pre-assembled ribonucleoprotein can be introduced into the plant cell via electroporation, by bombardment with Cpf1-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. *Nature Biotechnology*, 2015; DOI: 10.1038/nbt.3389).

In particular embodiments, the Cpf1 CRISPR system components are introduced into the plant cells using nanoparticles. The components, either as protein or nucleic acid or in a combination thereof, can be uploaded onto or packaged in nanoparticles and applied to the plants (such as for instance described in WO 2008042156 and US 20130185823). In particular, embodiments of the invention comprise nanoparticles uploaded with or packed with DNA molecule(s) encoding the Cpf1 protein, DNA molecules encoding the guide RNA and/or isolated guide RNA as described in WO2015089419.

Further means of introducing one or more components of the Cpf1 CRISPR system to the plant cell is by using cell penetrating peptides (CPP). Accordingly, in particular, embodiments the invention comprises compositions comprising a cell penetrating peptide linked to the Cpf1 protein. In particular embodiments of the present invention, the Cpf1 protein and/or guide RNA is coupled to one or more CPPs to effectively transport them inside plant protoplasts; see also Ramakrishna (20140Genome Res. 2014 June; 24(6):1020-7 for Cas9 in human cells). In other embodiments, the Cpf1 gene and/or guide RNA are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipatic peptides, peptides having proline-rich and anti-microbial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biolomolecule with the target. Examples of CPP include amongst others: Tat, a nuclear transcriptional activator protein required for viral replication by HIV type1, penetratin, Kaposi fibroblast growth factor (FGF) signal peptide sequence, integrin $\beta 3$ signal peptide sequence; polyarginine peptide Args sequence, Guanine rich-molecular transporters, sweet arrow peptide, etc. . . . . .

Use of the Cpf1 CRISPR System to Make Genetically Modified Non-Transgenic Plants In particular embodiments, the methods described herein are used to modify endogenous genes or to modify their expression without the permanent introduction into the genome of the plant of any foreign gene, including those encoding CRISPR components, so as to avoid the presence of foreign DNA in the genome of the plant. This can be of interest as the regulatory requirements for non-transgenic plants are less rigorous.

In particular embodiments, this is ensured by transient expression of the Cpf1 CRISPR components. In particular embodiments one or more of the CRISPR components are expressed on one or more viral vectors which produce sufficient Cpf1 protein and guide RNA to consistently steadily ensure modification of a gene of interest according to a method described herein.

In particular embodiments, transient expression of Cpf1 CRISPR constructs is ensured in plant protoplasts and thus not integrated into the genome. The limited window of expression can be sufficient to allow the Cpf1 CRISPR system to ensure modification of a target gene as described herein.

In particular embodiments, the different components of the Cpf1 CRISPR system are introduced in the plant cell, protoplast or plant tissue either separately or in mixture, with the aid of particulate delivering molecules such as nanoparticles or CPP molecules as described herein above.

The expression of the Cpf1 CRISPR components can induce targeted modification of the genome, either by direct activity of the Cpf1 nuclease and optionally introduction of template DNA or by modification of genes targeted using the Cpf1 CRISPR system as described herein. The different strategies described herein above allow Cpf1-mediated targeted genome editing without requiring the introduction of the Cpf1 CRISPR components into the plant genome. Components which are transiently introduced into the plant cell are typically removed upon crossing.

Detecting Modifications in the Plant Genome-Selectable Markers

In particular embodiments, where the method involves modification of an endogeneous target gene of the plant genome, any suitable method can be used to determine, after the plant, plant part or plant cell is infected or transfected with the Cpf1 CRISPR system, whether gene targeting or targeted mutagenesis has occurred at the target site. Where the method involves introduction of a transgene, a transformed plant cell, callus, tissue or plant may be identified and isolated by selecting or screening the engineered plant material for the presence of the transgene or for traits encoded by the transgene. Physical and biochemical methods may be used to identify plant or plant cell transformants containing inserted gene constructs or an endogenous DNA modification. These methods include but are not limited to: 1) Southern analysis or PCR amplification for detecting and determining the structure of the recombinant DNA insert or modified endogenous genes; 2) Northern blot, S1 RNase protection, primer-extension or reverse transcriptase-PCR amplification for detecting and examining RNA transcripts of the gene constructs; 3) enzymatic assays for detecting enzyme or ribozyme activity, where such gene products are encoded by the gene construct or expression is affected by the genetic modification; 4) protein gel electrophoresis, Western blot techniques, immunoprecipitation, or enzyme-linked immunoassays, where the gene construct or endogenous gene products are proteins. Additional techniques, such as in situ hybridization, enzyme staining, and immunostaining, also may be used to detect the presence or expression of the recombinant construct or detect a modification of endogenous gene in specific plant organs and tissues. The methods for doing all these assays are well known to those skilled in the art.

Additionally (or alternatively), the expression system encoding the Cpf1 CRISPR components is typically designed to comprise one or more selectable or detectable markers that provide a means to isolate or efficiently select cells that contain and/or have been modified by the Cpf1 CRISPR system at an early stage and on a large scale.

In the case of *Agrobacterium*-mediated transformation, the marker cassette may be adjacent to or between flanking T-DNA borders and contained within a binary vector. In another embodiment, the marker cassette may be outside of the T-DNA. A selectable marker cassette may also be within or adjacent to the same T-DNA borders as the expression cassette or may be somewhere else within a second T-DNA on the binary vector (e.g., a 2 T-DNA system).

For particle bombardment or with protoplast transformation, the expression system can comprise one or more isolated linear fragments or may be part of a larger construct that might contain bacterial replication elements, bacterial selectable markers or other detectable elements. The expression cassette(s) comprising the polynucleotides encoding the guide and/or Cpf1 may be physically linked to a marker cassette or may be mixed with a second nucleic acid molecule encoding a marker cassette. The marker cassette is comprised of necessary elements to express a detectable or selectable marker that allows for efficient selection of transformed cells.

The selection procedure for the cells based on the selectable marker will depend on the nature of the marker gene. In particular embodiments, use is made of a selectable marker, i.e. a marker which allows a direct selection of the cells based on the expression of the marker. A selectable marker can confer positive or negative selection and is conditional or non-conditional on the presence of external substrates (Miki et al. 2004, 107(3): 193-232). Most commonly, antibiotic or herbicide resistance genes are used as a marker, whereby selection is be performed by growing the engineered plant material on media containing an inhibitory amount of the antibiotic or herbicide to which the marker gene confers resistance. Examples of such genes are genes that confer resistance to antibiotics, such as hygromycin (hpt) and kanamycin (nptII), and genes that confer resistance to herbicides, such as phosphinothricin (bar) and chlorosulfuron (als), Transformed plants and plant cells may also be identified by screening for the activities of a visible marker, typically an enzyme capable of processing a colored substrate (e.g., the β-glucuronidase, luciferase, B or C1 genes). Such selection and screening methodologies are well known to those skilled in the art.

Plant Cultures and Regeneration

In particular embodiments, plant cells which have a modified genome and that are produced or obtained by any of the methods described herein, can be cultured to regenerate a whole plant which possesses the transformed or modified genotype and thus the desired phenotype. Conventional regeneration techniques are well known to those skilled in the art. Particular examples of such regeneration techniques rely on manipulation of certain phytohormones in a tissue culture growth medium, and typically relying on a biocide and/or herbicide marker which has been introduced together with the desired nucleotide sequences. In further particular embodiments, plant regeneration is obtained from cultured protoplasts, plant callus, explants, organs, pollens, embryos or parts thereof (see e.g. Evans et al. (1983), Handbook of Plant Cell Culture, Klee et al (1987) Ann. Rev. of Plant Phys.).

In particular embodiments, transformed or improved plants as described herein can be self-pollinated to provide seed for homozygous improved plants of the invention (homozygous for the DNA modification) or crossed with non-transgenic plants or different improved plants to provide seed for heterozygous plants. Where a recombinant DNA was introduced into the plant cell, the resulting plant of such a crossing is a plant which is heterozygous for the recombinant DNA molecule. Both such homozygous and heterozygous plants obtained by crossing from the improved plants and comprising the genetic modification (which can be a recombinant DNA) are referred to herein as "progeny". Progeny plants are plants descended from the original transgenic plant and containing the genome modification or recombinant DNA molecule introduced by the methods provided herein. Alternatively, genetically modified plants can be obtained by one of the methods described supra using the Cfp1 enzyme whereby no foreign DNA is incorporated into the genome. Progeny of such plants, obtained by further breeding may also contain the genetic modification. Breedings are performed by any breeding methods that are commonly used for different crops (e.g., Allard, Principles of Plant Breeding, John Wiley & Sons, NY, U. of CA, Davis, CA, 50-98 (1960).

Generation of Plants with Enhanced Agronomic Traits

The Cpf1 based CRISPR systems provided herein can be used to introduce targeted double-strand or single-strand breaks and/or to introduce gene activator and or repressor systems and without being limitative, can be used for gene targeting, gene replacement, targeted mutagenesis, targeted deletions or insertions, targeted inversions and/or targeted translocations. By co-expression of multiple targeting RNAs directed to achieve multiple modifications in a single cell, multiplexed genome modification can be ensured. This technology can be used to high-precision engineering of plants with improved characteristics, including enhanced nutritional quality, increased resistance to diseases and resistance to biotic and abiotic stress, and increased production of commercially valuable plant products or heterologous compounds.

In particular embodiments, the Cpf1 CRISPR system as described herein is used to introduce targeted double-strand breaks (DSB) in an endogenous DNA sequence. The DSB activates cellular DNA repair pathways, which can be harnessed to achieve desired DNA sequence modifications near the break site. This is of interest where the inactivation of endogenous genes can confer or contribute to a desired trait. In particular embodiments, homologous recombination with a template sequence is promoted at the site of the DSB, in order to introduce a gene of interest.

In particular embodiments, the Cpf1 CRISPR system may be used as a generic nucleic acid binding protein with fusion to or being operably linked to a functional domain for activation and/or repression of endogenous plant genes. Exemplary functional domains may include but are not limited to translational initiator, translational activator, translational repressor, nucleases, in particular ribonucleases, a spliceosome, beads, a light inducible/controllable domain or a chemically inducible/controllable domain. Typically in these embodiments, the Cpf1 protein comprises at least one mutation, such that it has no more than 5% of the activity of the Cpf1 protein not having the at least one mutation; the guide RNA comprises a guide sequence capable of hybridizing to a target sequence.

The methods described herein generally result in the generation of "improved plants" in that they have one or more desirable traits compared to the wildtype plant. In particular embodiments, the plants, plant cells or plant parts obtained are transgenic plants, comprising an exogenous DNA sequence incorporated into the genome of all or part of the cells of the plant. In particular embodiments, non-transgenic genetically modified plants, plant parts or cells are obtained, in that no exogenous DNA sequence is incorporated into the genome of any of the plant cells of the plant. In such embodiments, the improved plants are non-transgenic. Where only the modification of an endogenous gene is ensured and no foreign genes are introduced or maintained in the plant genome, the resulting genetically modified crops contain no foreign genes and can thus basically be considered non-transgenic. The different applications of the Cpf1 CRISPR system for plant genome editing are described more in detail below:

a) Introduction of One or More Foreign Genes to Confer an Agricultural Trait of Interest The invention provides methods of genome editing or modifying sequences associated with or at a target locus of interest wherein the method comprises introducing a Cpf1 effector protein complex into a plant cell, whereby the Cpf1 effector protein complex effectively functions to integrate a DNA insert, e.g. encoding a foreign gene of interest, into the genome of the plant cell. In preferred embodiments the integration of the DNA insert is facilitated by HR with an exogenously introduced DNA template or repair template. Typically, the exogenously introduced DNA template or repair template is delivered together with the Cpf1 effector protein complex or one component or a polynucleotide vector for expression of a component of the complex.

The Cpf1 CRISPR systems provided herein allow for targeted gene delivery. It has become increasingly clear that the efficiency of expressing a gene of interest is to a great extent determined by the location of integration into the genome. The present methods allow for targeted integration of the foreign gene into a desired location in the genome. The location can be selected based on information of previously generated events or can be selected by methods disclosed elsewhere herein.

In particular embodiments, the methods provided herein include (a) introducing into the cell a Cpf1 CRISPR complex comprising a guide RNA, comprising a direct repeat and a guide sequence, wherein the guide sequence hybrdizes to a target sequence that is endogenous to the plant cell; (b) introducing into the plant cell a Cpf1 effector molecule which complexes with the guide RNA when the guide sequence hybridizes to the target sequence and induces a double strand break at or near the sequence to which the guide sequence is targeted; and (c) introducing into the cell a nucleotide sequence encoding an HDR repair template which encodes the gene of interest and which is introduced into the location of the DS break as a result of HDR. In particular embodiments, the step of introducing can include delivering to the plant cell one or more polynucleotides encoding Cpf1 effector protein, the guide RNA and the repair template. In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the Cpf1 effector protein, the guide RNA and the repair template, where the delivering is via *Agrobacterium*. The nucleic acid sequence encoding the Cpf1 effector protein can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the repair template i.e. the gene of interest has been introduced. In particular embodiments, the methods include the step of regenerating a plant from the plant cell. In further embodiments, the methods include cross breeding the plant to obtain a genetically desired plant lineage. Examples of foreign genes encoding a trait of interest are listed below.

b) Editing of Endogenous Genes to Confer an Agricultural Trait of Interest

The invention provides methods of genome editing or modifying sequences associated with or at a target locus of interest wherein the method comprises introducing a Cpf1 effector protein complex into a plant cell, whereby the Cpf1 complex modifies the expression of an endogenous gene of the plant. This can be achieved in different ways, In particular embodiments, the elimination of expression of an endogenous gene is desirable and the Cpf1 CRISPR complex is used to target and cleave an endogenous gene so as to modify gene expression. In these embodiments, the methods provided herein include (a) introducing into the plant cell a Cpf1 CRISPR complex comprising a guide RNA, comprising a direct repeat and a guide sequence, wherein the guide sequence hybrdizes to a target sequence within a gene of interest in the genome of the plant cell; and (b) introducing into the cell a Cpf1 effector protein, which upon binding to the guide RNA comprises a guide sequence that is hybridized to the target sequence, ensures a double strand break at or near the sequence to which the guide sequence is targeted; In particular embodiments, the step of introducing can include delivering to the plant cell one or more polynucleotides encoding Cpf1 effector protein and the guide RNA.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the Cpf1 effector protein and the guide RNA, where the delivering is via *Agrobacterium*. The polynucleotide sequence encoding the components of the Cpf1 CRISPR system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage.

In particular embodiments of the methods described above, disease resistant crops are obtained by targeted mutation of disease susceptibility genes or genes encoding negative regulators (e.g. Mlo gene) of plant defense genes. In a particular embodiment, herbicide-tolerant crops are generated by targeted substitution of specific nucleotides in plant genes such as those encoding acetolactate synthase (ALS) and protoporphyrinogen oxidase (PPO). In particular embodiments drought and salt tolerant crops by targeted mutation of genes encoding negative regulators of abiotic stress tolerance, low amylose grains by targeted mutation of Waxy gene, rice or other grains with reduced rancidity by targeted mutation of major lipase genes in aleurone layer, etc. In particular embodiments. A more extensive list of endogenous genes encoding a traits of interest are listed below.

c) Modulating of Endogenous Genes by the Cpf1 CRISPR System to Confer an Agricultural Trait of Interest Also provided herein are methods for modulating (i.e. activating or repressing) endogenous gene expression using the Cpf1 protein provided herein. Such methods make use of distinct RNA sequence(s) which are targeted to the plant genome by the Cpf1 complex. More particularly the distinct RNA sequence(s) bind to two or more adaptor proteins (e.g. aptamers) whereby each adaptor protein is associated with one or more functional domains and wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity; The functional domains are used to modulate expression of an endogenous plant gene so as to obtain the desired trait. Typically, in these embodiments, the Cpf1 effector protein has one or more mutations such that it has no more than 5% of the nuclease activity of the Cpf1 effector protein not having the at least one mutation.

In particular embodiments, the methods provided herein include the steps of (a) introducing into the cell a Cpf1 CRISPR complex comprising a guide RNA, comprising a direct repeat and a guide sequence, wherein the guide sequence hybrdizes to a target sequence that is endogenous to the plant cell; (b) introducing into the plant cell a Cpf1 effector molecule which complexes with the guide RNA when the guide sequence hybridizes to the target sequence; and wherein either the guide RNA is modified to comprise a distinct RNA sequence (aptamer) binding to a functional domain and/or the Cpf1 effector protein is modified in that it is linked to a functional domain. In particular embodiments, the step of introducing can include delivering to the plant cell one or more polynucleotides encoding the (modified) Cpf1 effector protein and the (modified) guide RNA. The details the components of the Cpf1 CRISPR system for use in these methods are described elsewhere herein.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the Cpf1 effector protein and the guide RNA, where the delivering is via Agrobacterium. The nucleic acid sequence encoding the one or more components of the Cpf1 CRISPR system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage. A more extensive list of endogenous genes encoding a traits of interest are listed below.

Use of Cpf1 to Modify Polyploid Plants

Many plants are polyploid, which means they carry duplicate copies of their genomes-sometimes as many as six, as in wheat. The methods according to the present invention, which make use of the Cpf1 CRISPR effector protein can be "multiplexed" to affect all copies of a gene, or to target dozens of genes at once. For instance, in particular embodiments, the methods of the present invention are used to simultaneously ensure a loss of function mutation in different genes responsible for suppressing defenses against a disease. In particular embodiments, the methods of the present invention are used to simultaneously suppress the expression of the TaMLO-A1, TaMLO-B1 and TaMLO-D1 nucleic acid sequence in a wheat plant cell and regenerating a wheat plant therefrom, in order to ensure that the wheat plant is resistant to powdery mildew (see also WO2015109752).

Exemplary Genes Conferring Agronomic Traits

As described herein above, in particular embodiments, the invention encompasses the use of the Cpf1 CRISPR system as described herein for the insertion of a DNA of interest, including one or more plant expressible gene(s). In further particular embodiments, the invention encompasses methods and tools using the Cpf1 system as described herein for partial or complete deletion of one or more plant expressed gene(s). In other further particular embodiments, the invention encompasses methods and tools using the Cpf1 system as described herein to ensure modification of one or more plant-expressed genes by mutation, substitution, insertion of one of more nucleotides. In other particular embodiments, the invention encompasses the use of Cpf1 CRISPR system as described herein to ensure modification of expression of one or more plant-expressed genes by specific modification of one or more of the regulatory elements directing expression of said genes.

In particular embodiments, the invention encompasses methods which involve the introduction of exogenous genes and/or the targeting of endogenous genes and their regulatory elements, such as listed below:

1. Genes that Confer Resistance to Pests or Diseases:

Plant disease resistance genes. A plant can be transformed with cloned resistance genes to engineer plants that are resistant to specific pathogen strains. See, e.g., Jones et al., Science 266:789 (1994) (cloning of the tomato Cf-9 gene for resistance to *Cladosporium fulvum*); Martin et al., Science 262:1432 (1993) (tomato Pto gene for resistance to *Pseudomonas syringae* pv. tomato encodes a protein kinase); Mindrinos et al., Cell 78:1089 (1994) (Arabidopsmay be RSP2 gene for resistance to *Pseudomonas syringae*).

Genes conferring resistance to a pest, such as soybean cyst nematode. See e.g., PCT Application WO 96/30517; PCT Application WO 93/19181.

*Bacillus thuringiensis* proteins see, e.g., Geiser et al., Gene 48:109 (1986).

Lectins, see, for example, Van Damme et al., Plant Molec. Biol. 24:25 (1994.

Vitamin-binding protein, such as avidin, see PCT application US93/06487, teaching the use of avidin and avidin homologues as larvicides against insect pests.

Enzyme inhibitors such as protease or proteinase inhibitors or amylase inhibitors. See, e.g., Abe et al., J. Biol.

Chem. 262:16793 (1987), Huub et al., Plant Molec. Biol. 21:985 (1993)), Sumitani et al., Biosci. Biotech. Biochem. 57:1243 (1993) and U.S. Pat. No. 5,494,813.

Insect-specific hormones or pheromones such as ecdysteroid or juvenile hormone, a variant thereof, a mimetic based thereon, or an antagonist or agonist thereof. See, for example Hammock et al., Nature 344:458 (1990).

Insect-specific peptides or neuropeptides which, upon expression, disrupts the physiology of the affected pest. For example Regan, J. Biol. Chem. 269:9 (1994) and Pratt et al., Biochem. Biophys. Res. Comm. 163:1243 (1989). See also U.S. Pat. No. 5,266,317.

Insect-specific venom produced in nature by a snake, a wasp, or any other organism. For example, see Pang et al., Gene 116: 165 (1992).

Enzymes responsible for a hyperaccumulation of a monoterpene, a sesquiterpene, a steroid, hydroxamic acid, a phenylpropanoid derivative or another nonprotein molecule with insecticidal activity.

Enzymes involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See PCT application WO93/02197, Kramer et al., Insect Biochem. Molec. Biol. 23:691 (1993) and Kawalleck et al., Plant Molec. Biol. 21:673 (1993).

Molecules that stimulates signal transduction. For example, see Botella et al., Plant Molec. Biol. 24:757 (1994), and Griess et al., Plant Physiol. 104:1467 (1994).

Viral-invasive proteins or a complex toxin derived therefrom. See Beachy et al., Ann. rev. Phytopathol. 28:451 (1990).

Developmental-arrestive proteins produced in nature by a pathogen or a parasite. See Lamb et al., Bio/Technology 10:1436 (1992) and Toubart et al., Plant J. 2:367 (1992).

A developmental-arrestive protein produced in nature by a plant. For example, Logemann et al., Bio/Technology 10:305 (1992).

In plants, pathogens are often host-specific. For example, some *Fusarium* species will causes tomato wilt but attacks only tomato, and other *Fusarium* species attack only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible or there can be partial resistance against all races of a pathogen, typically controlled by many genes and/or also complete resistance to some races of a pathogen but not to other races. Such resistance is typically controlled by a few genes. Using methods and components of the CRISP-cpf1 system, a new tool now exists to induce specific mutations in anticipation hereon. Accordingly, one can analyze the genome of sources of resistance genes, and in plants having desired characteristics or traits, use the method and components of the Cpf1 CRISPR system to induce the rise of resistance genes. The present systems can do so with more precision than previous mutagenic agents and hence accelerate and improve plant breeding programs.

2. Genes Involved in Plant Diseases, Such as Those Listed in WO 2013046247:

Rice diseases: *Magnaporthe grisea, Cochliobolus miyabeanus, Rhizoctonia solani, Gibberella fujikuroi*;

Wheat diseases: *Erysiphe graminis, Fusarium graminearum, F. avenaceum, F. culmorum, Microdochium nivale, Puccinia striiformis, P. graminis, P. recondita, Micronectriella nivale, Typhula* sp., *Ustilago tritici, Tilletia caries, Pseudocercosporella herpotrichoides, Mycosphaerella graminicola, Stagonospora nodorum, Pyrenophora tritici-repentis*; Barley diseases: *Erysiphe graminis, Fusarium graminearum, F. avenaceum, F. culmorum, Microdochium nivale, Puccinia striiformis, P. graminis, P. hordei, Ustilago nuda, Rhynchosporium secalis, Pyrenophora teres, Cochliobolus sativus, Pyrenophora graminea, Rhizoctonia solani*; Maize diseases: *Ustilago maydis, Cochliobolus heterostrophus, Gloeocercospora sorghi, Puccinia polysora, Cercospora zeae-maydis, Rhizoctonia solani;*

Citrus diseases: *Diaporthe citri, Elsinoe fawcetti, Penicillium digitatum, P. italicum, Phytophthora parasitica, Phytophthora citrophthora*; Apple diseases: *Monilinia mali, Valsa ceratosperma, Podosphaera leucotricha, Alternaria alternata* apple pathotype, *Venturia inaequalis, Colletotrichum acutatum, Phytophtora cactorum;*

Pear diseases: *Venturia nashicola, V. pirina, Alternaria alternata* Japanese pear pathotype, *Gymnosporangium haraeanum, Phytophtora cactorum;*

Peach diseases: *Monilinia fructicola, Cladosporium carpophilum, Phomopsis* sp.;

Grape diseases: *Elsinoe ampelina, Glomerella cingulata, Uninula necator, Phakopsora ampelopsidis, Guignardia bidwellii, Plasmopara viticola;*

Persimmon diseases: *Gloesporium kaki, Cercospora kaki, Mycosphaerela nawae;*

Gourd diseases: *Colletotrichum lagenarium, Sphaerotheca fuliginea, Mycosphaerella melonis, Fusarium oxysporum, Pseudoperonospora cubensis, Phytophthora* sp., *Pythium* sp.;

Tomato diseases: *Alternaria solani, Cladosporium fulvum, Phytophthora infestans;*

Eggplant diseases: *Phomopsis vexans, Erysiphe cichoracearum;*

Brassicaceous vegetable diseases: *Alternaria japonica, Cercosporella brassicae, Plasmodiophora brassicae, Peronospora parasitica;*

Welsh onion diseases: *Puccinia allii, Peronospora destructor;*

Soybean diseases: *Cercospora kikuchii, Elsinoe glycines, Diaporthe phaseolorum* var. *sojae, Septoria glycines, Cercospora sojina, Phakopsora pachyrhizi, Phytophthora sojae, Rhizoctonia solani, Corynespora casiicola, Sclerotinia sclerotiorum;*

Kidney bean diseases: *Colletrichum lindemthianum;*

Peanut diseases: *Cercospora personata, Cercospora arachidicola, Sclerotium rolfsii;*

Pea diseases pea: *Erysiphe pisi;*

Potato diseases: *Alternaria solani, Phytophthora infestans, Phytophthora erythroseptica, Spongospora subterranean,* f. sp. *Subterranean;*

Strawberry diseases: *Sphaerotheca humuli, Glomerella cingulata;*

Tea diseases: *Exobasidium reticulatum, Elsinoe leucospila, Pestalotiopsis* sp., *Colletotrichum theae-sinensis;*

Tobacco diseases: *Alternaria longipes, Erysiphe cichoracearum, Colletotrichum tabacum, Peronospora tabacina, Phytophthora nicotianae;*

Rapeseed diseases: *Sclerotinia sclerotiorum, Rhizoctonia solani;*
Cotton diseases: *Rhizoctonia solani;*
Beet diseases: *Cercospora beticola, Thanatephorus cucumeris, Thanatephorus cucumeris, Aphanomyces cochlioides;*
Rose diseases: *Diplocarpon rosae, Sphaerotheca pannosa, Peronospora sparsa;*
Diseases of *chrysanthemum* and asteraceae: *Bremia lactuca, Septoria chrysanthemi-indici, Puccinia horiana;*
Diseases of various plants: *Pythium aphanidermatum, Pythium debarianum, Pythium graminicola, Pythium irregulare, Pythium ultimum, Botrytis cinerea, Sclerotinia sclerotiorum;*
Radish diseases: *Alternaria brassicicola;* Zoysia diseases: *Sclerotinia homeocarpa, Rhizoctonia solani;*
Banana diseases: *Mycosphaerella fijiensis, Mycosphaerella musicola;*
Sunflower diseases: *Plasmopara halstedii;*
Seed diseases or diseases in the initial stage of growth of various plants caused by *Aspergillus* spp., *Penicillium* spp., *Fusarium* spp., *Gibberella* spp., *Tricoderma* spp., *Thielaviopsis* spp., *Rhizopus* spp., *Mucor* spp., *Corticium* spp., *Rhoma* spp., *Rhizoctonia* spp., *Diplodia* spp., or the like;
Virus diseases of various plants mediated by *Polymixa* spp., *Olpidium* spp., or the like.

3. Examples of Genes that Confer Resistance to Herbicides:

Resistance to herbicides that inhibit the growing point or meristem, such as an imidazolinone or a sulfonylurea, for example, by Lee et al., EMBO J. 7:1241 (1988), and Miki et al., Theor. Appl. Genet. 80:449 (1990), respectively.

Glyphosate tolerance (resistance conferred by, e.g., mutant 5-enolpyruvylshikimate-3-phosphate synthase (EPSPs) genes, aroA genes and glyphosate acetyl transferase (GAT) genes, respectively), or resistance to other phosphono compounds such as by glufosinate (phosphinothricin acetyl transferase (PAT) genes from *Streptomyces* species, including *Streptomyces hygroscopicus* and *Streptomyces viridichromogenes*), and to pyridinoxy or phenoxy proprionic acids and cyclohexones by ACCase inhibitor-encoding genes. See, for example, U.S. Pat. Nos. 4,940,835 and 6,248,876, 4,769,061, EP No. 0 333 033 and U.S. Pat. No. 4,975,374. See also EP No. 0242246, DeGreef et al., Bio/Technology 7:61 (1989), Marshall et al., Theor. Appl. Genet. 83:435 (1992), WO 2005012515 to Castle et. al. and WO 2005107437.

Resistance to herbicides that inhibit photosynthesis, such as a triazine (psbA and gs+ genes) or a benzonitrile (nitrilase gene), and glutathione S-transferase in Przibila et al., Plant Cell 3:169 (1991), U.S. Pat. No. 4,810,648, and Hayes et al., Biochem. J. 285: 173 (1992).

Genes encoding Enzymes detoxifying the herbicide or a mutant glutamine synthase enzyme that is resistant to inhibition, e.g. n U.S. patent application Ser. No. 11/760,602. Or a detoxifying enzyme is an enzyme encoding a phosphinothricin acetyltransferase (such as the bar or pat protein from *Streptomyces* species). Phosphinothricin acetyltransferases are for example described in U.S. Pat. Nos. 5,561,236; 5,648,477; 5,646,024; 5,273,894; 5,637,489; 5,276,268; 5,739,082; 5,908,810 and 7,112,665.

Hydroxyphenylpyruvatedioxygenases (HPPD) inhibitors, ie naturally occurring HPPD resistant enzymes, or genes encoding a mutated or chimeric HPPD enzyme as described in WO 96/38567, WO 99/24585, and WO 99/24586, WO 2009/144079, WO 2002/046387, or U.S. Pat. No. 6,768,044.

4. Examples of Genes Involved in Abiotic Stress Tolerance:

Transgene capable of reducing the expression and/or the activity of poly(ADP-ribose) polymerase (PARP) gene in the plant cells or plants as described in WO 00/04173 or, WO/2006/045633.

Transgenes capable of reducing the expression and/or the activity of the PARG encoding genes of the plants or plants cells, as described e.g. in WO 2004/090140.

Transgenes coding for a plant-functional enzyme of the nicotineamide adenine dinucleotide salvage synthesis pathway including nicotinamidase, nicotinate phosphoribosyltransferase, nicotinic acid mononucleotide adenyl transferase, nicotinamide adenine dinucleotide synthetase or nicotine amide phosphorybosyltransferase as described e.g. in EP 04077624.7, WO 2006/133827, PCT/EP07/002,433, EP 1999263, or WO 2007/107326.

Enzymes involved in carbohydrate biosynthesis include those described in e.g. EP 0571427, WO 95/04826, EP 0719338, WO 96/15248, WO 96/19581, WO 96/27674, WO 97/11188, WO 97/26362, WO 97/32985, WO 97/42328, WO 97/44472, WO 97/45545, WO 98/27212, WO 98/40503, WO99/58688, WO 99/58690, WO 99/58654, WO 00/08184, WO 00/08185, WO 00/08175, WO 00/28052, WO 00/77229, WO 01/12782, WO 01/12826, WO 02/101059, WO 03/071860, WO 2004/056999, WO 2005/030942, WO 2005/030941, WO 2005/095632, WO 2005/095617, WO 2005/095619, WO 2005/095618, WO 2005/123927, WO 2006/018319, WO 2006/103107, WO 2006/108702, WO 2007/009823, WO 00/22140, WO 2006/063862, WO 2006/072603, WO 02/034923, EP 06090134.5, EP 06090228.5, EP 06090227.7, EP 07090007.1, EP 07090009.7, WO 01/14569, WO 02/79410, WO 03/33540, WO 2004/078983, WO 01/19975, WO 95/26407, WO 96/34968, WO 98/20145, WO 99/12950, WO 99/66050, WO 99/53072, U.S. Pat. No. 6,734,341, WO 00/11192, WO 98/22604, WO 98/32326, WO 01/98509, WO 01/98509, WO 2005/002359, U.S. Pat. Nos. 5,824,790, 6,013,861, WO 94/04693, WO 94/09144, WO 94/11520, WO 95/35026 or WO 97/20936 or enzymes involved in the production of polyfructose, especially of the inulin and levan-type, as disclosed in EP 0663956, WO 96/01904, WO 96/21023, WO 98/39460, and WO 99/24593, the production of alpha-1,4-glucans as disclosed in WO 95/31553, US 2002031826, U.S. Pat. Nos. 6,284,479, 5,712,107, WO 97/47806, WO 97/47807, WO 97/47808 and WO 00/14249, the production of alpha-1,6 branched alpha-1,4-glucans, as disclosed in WO 00/73422, the production of alternan, as disclosed in e.g. WO 00/47727, WO 00/73422, EP 06077301.7, U.S. Pat. No. 5,908,975 and EP 0728213, the production of hyaluronan, as for example disclosed in WO 2006/032538, WO 2007/039314, WO 2007/039315, WO 2007/039316, JP 2006304779, and WO 2005/012529. Genes that improve drought resistance. For example, WO 2013122472 discloses that the absence or reduced level of functional Ubiquitin Protein Ligase protein (UPL) protein, more specifically, UPL3, leads to a decreased need for water or improved resistance to drought of said plant. Other examples of transgenic plants with increased drought tolerance are disclosed in, for example, US 2009/0144850, US 2007/0266453, and WO 2002/083911. US2009/0144850 describes a plant displaying a drought tolerance phenotype due to altered expression of a DR02 nucleic acid. US 2007/0266453 describes a plant displaying a drought tolerance phenotype due to altered expression of a DR03 nucleic acid and WO 2002/08391 1 describes a plant having an increased tolerance to drought stress due to a reduced activity of an ABC transporter which is expressed in guard cells. Another example is the work by Kasuga and coauthors (1999), who describe that overexpression of cDNA encoding DREB1 A in transgenic plants activated the expression of many stress tolerance genes under normal growing conditions and resulted in improved tolerance to drought, salt loading, and freezing. However, the expression of DREB1A also resulted in severe growth retardation under normal growing conditions (Kasuga (1999) Nat Biotechnol 17(3) 287-291).

In further particular embodiments, crop plants can be improved by influencing specific plant traits. For example, by developing pesticide-resistant plants, improving disease resistance in plants, improving plant insect and nematode resistance, improving plant resistance against parasitic weeds, improving plant drought tolerance, improving plant nutritional value, improving plant stress tolerance, avoiding self-pollination, plant forage digestibility biomass, grain yield etc. A few specific non-limiting examples are provided hereinbelow.

In addition to targeted mutation of single genes, Cpf1CRISPR complexes can be designed to allow targeted mutation of multiple genes, deletion of chromosomal fragment, site-specific integration of transgene, site-directed mutagenesis in vivo, and precise gene replacement or allele swapping in plants. Therefore, the methods described herein have broad applications in gene discovery and validation, mutational and cisgenic breeding, and hybrid breeding. These applications facilitate the production of a new generation of genetically modified crops with various improved agronomic traits such as herbicide resistance, disease resistance, abiotic stress tolerance, high yield, and superior quality.

Use of Cpf1 Gene to Create Male Sterile Plants

Hybrid plants typically have advantageous agronomic traits compared to inbred plants. However, for self-pollinating plants, the generation of hybrids can be challenging. In different plant types, genes have been identified which are important for plant fertility, more particularly male fertility. For instance, in maize, at least two genes have been identified which are important in fertility (Amitabh Mohanty International Conference on New Plant Breeding Molecular Technologies Technology Development And Regulation, Oct. 9-10, 2014, Jaipur, India; Svitashev et al. Plant Physiol. 2015 October; 169(2):931-45; Djukanovic et al. Plant J. 2013 December; 76(5):888-99). The methods provided herein can be used to target genes required for male fertility so as to generate male sterile plants which can easily be crossed to generate hybrids. In particular embodiments, the Cpf1 CRISPR system provided herein is used for targeted mutagenesis of the cytochrome P450-like gene (MS26) or the meganuclease gene (MS45) thereby conferring male sterility to the maize plant. Maize plants which are as such genetically altered can be used in hybrid breeding programs.

Increasing the Fertility Stage in Plants

In particular embodiments, the methods provided herein are used to prolong the fertility stage of a plant such as of a rice plant. For instance, a rice fertility stage gene such as Ehd3 can be targeted in order to generate a mutation in the gene and plantlets can be selected for a prolonged regeneration plant fertility stage (as described in CN 104004782)

Use of Cpf1 to Generate Genetic Variation in a Crop of Interest

The availability of wild germplasm and genetic variations in crop plants is the key to crop improvement programs, but the available diversity in germplasms from crop plants is limited. The present invention envisages methods for generating a diversity of genetic variations in a germplasm of interest. In this application of the Cpf1 CRISPR system a library of guide RNAs targeting different locations in the plant genome is provided and is introduced into plant cells together with the Cpf1 effector protein. In this way a collection of genome-scale point mutations and gene knock-outs can be generated. In particular embodiments, the methods comprise generating a plant part or plant from the cells so obtained and screening the cells for a trait of interest. The target genes can include both coding and non-coding regions. In particular embodiments, the trait is stress tolerance and the method is a method for the generation of stress-tolerant crop varieties Use of Cpf1 to Affect Fruit-Ripening Ripening is a normal phase in the maturation process of fruits and vegetables. Only a few days after it starts it renders a fruit or vegetable inedible. This process brings significant losses to both farmers and consumers. In particular embodiments, the methods of the present invention are used to reduce ethylene production. This is ensured by ensuring one or more of the following: a. Suppression of ACC synthase gene expression. ACC (1-aminocyclopropane-1-carboxylic acid) synthase is the enzyme responsible for the conversion of S-adenosylmethionine (SAM) to ACC; the second to the last step in ethylene biosynthesis. Enzyme expression is hindered when an antisense ("mirror-image") or truncated copy of the synthase gene is inserted into the plant's genome; b. Insertion of the ACC deaminase gene. The gene coding for the enzyme is obtained from *Pseudomonas chlororaphis*, a common nonpathogenic soil bacterium. It converts ACC to a different compound thereby reducing the amount of ACC available for ethylene production; c. Insertion of the SAM hydrolase gene. This approach is similar to ACC deaminase wherein ethylene production is hindered when the amount of its precursor metabolite is reduced; in this case SAM is converted to homoserine. The gene coding for the enzyme is obtained from *E. coli* T3 bacteriophage and d. Suppression of ACC oxidase gene expression. ACC oxidase is the enzyme which catalyzes the oxidation of ACC to ethylene, the last step in the ethylene biosynthetic pathway. Using the methods described herein, down regulation of the ACC oxidase gene results in the suppression of ethylene production, thereby delaying fruit ripening. In particular embodiments, additionally or alternatively to the modifications described above, the methods described herein are used to modify ethylene receptors, so as to interfere with ethylene signals obtained by the fruit. In particular embodiments, expression of the ETR1 gene, encoding an ethylene binding protein is modified, more particularly suppressed. In particular embodiments, additionally or alternatively to the modifications described above, the methods described herein are used to modify expression of the gene encoding Polygalacturonase (PG), which is the enzyme responsible for the breakdown of pectin, the substance that maintains the integrity of plant cell walls. Pectin breakdown occurs at the start of the ripening process resulting in the softening of the fruit. Accordingly, in particular embodiments, the methods described herein are used to introduce a mutation in the PG gene or to suppress activation of the PG gene in order to reduce the amount of PG enzyme produced thereby delaying pectin degradation.

Thus in particular embodiments, the methods comprise the use of the Cpf1 CRISPR system to ensure one or more modifications of the genome of a plant cell such as described above, and regenerating a plant therefrom. In particular embodiments, the plant is a tomato plant.

Increasing Storage Life of Plants

In particular embodiments, the methods of the present invention are used to modify genes involved in the production of compounds which affect storage life of the plant or plant part. More particularly, the modification is in a gene that prevents the accumulation of reducing sugars in potato tubers. Upon high-temperature processing, these reducing sugars react with free amino acids, resulting in brown, bitter-tasting products and elevated levels of acrylamide, which is a potential carcinogen. In particular embodiments, the methods provided herein are used to reduce or inhibit expression of the vacuolar invertase gene (VInv), which encodes a protein that breaks down sucrose to glucose and fructose (Clasen et al. DOI: 10.1111/pbi.12370).

The Use of the Cpf1 CRISPR System to Ensure a Value Added Trait

In particular embodiments the Cpf1 CRISPR system is used to produce nutritionally improved agricultural crops. In particular embodiments, the methods provided herein are adapted to generate "functional foods", i.e. a modified food or food ingredient that may provide a health benefit beyond the traditional nutrients it contains and or "nutraceutical", i.e. substances that may be considered a food or part of a food and provides health benefits, including the prevention and treatment of disease. In particular embodiments, the nutraceutical is useful in the prevention and/or treatment of one or more of cancer, diabetes, cardiovascular disease, and hypertension.

Examples of nutritionally improved crops include (Newell-McGloughlin, Plant Physiology, July 2008, Vol. 147, pp. 939-953):

modified protein quality, content and/or amino acid composition, such as have been described for Bahiagrass (Luciani et al. 2005, Florida Genetics Conference Poster), Canola (Roesler et al., 1997, Plant Physiol 113 75-81), Maize (Cromwell et al, 1967, 1969 J Anim Sci 26 1325-1331, O'Quin et al. 2000 J Anim Sci 78 2144-2149, Yang et al. 2002, Transgenic Res 11 11-20, Young et al. 2004, Plant J 38 910-922), Potato (Yu J and Ao, 1997 Acta Bot Sin 39 329-334; Chakraborty et al. 2000, Proc Natl Acad Sci USA 97 3724-3729; Li et al. 2001) Chin Sci Bull 46 482-484, Rice (Katsube et al. 1999, Plant Physiol 120 1063-1074), Soybean (Dinkins et al. 2001, Rapp 2002, In Vitro Cell Dev Biol Plant 37 742-747), Sweet Potato (Egnin and Prakash 1997, In Vitro Cell Dev Biol 33 52A).

essential amino acid content, such as has been described for Canola (Falco et al. 1995, Bio/Technology 13 577-582), Lupin (White et al. 2001, J Sci Food Agric 81 147-154), Maize (Lai and Messing, 2002, Agbios 2008 GM crop database (Mar. 11, 2008)), Potato (Zeh et al. 2001, Plant Physiol 127 792-802), Sorghum (Zhao et al. 2003, Kluwer Academic Publishers, Dordrecht, The Netherlands, pp 413-416), Soybean (Falco et al. 1995 Bio/Technology 13 577-582; Galili et al. 2002 Crit Rev Plant Sci 21 167-204).

Oils and Fatty acids such as for Canola (Dehesh et al. (1996) Plant J 9 167-172 [PubMed]; Del Vecchio (1996) INFORM International News on Fats, Oils and Related Materials 7 230-243; Roesler et al. (1997) Plant Physiol 113 75-81 [PMC free article] [PubMed]; Froman and Ursin (2002, 2003) Abstracts of Papers of the American Chemical Society 223 U35; James et al. (2003) Am J Clin Nutr 77 1140-1145 [PubMed]; Agbios (2008, above); coton (Chapman et al. (2001). J Am Oil Chem Soc 78 941-947; Liu et al. (2002) J Am Coll Nutr 21 205S-211S [PubMed]; O'Neill (2007) Australian Life Scientist. worldwideweb.biotechnews.com.au/index.php/id; 866694817; fp; 4; fpid; 2 (Jun. 17, 2008), Linseed (Abbadi et al., 2004, Plant Cell 16: 2734-2748), Maize (Young et al., 2004, Plant J 38 910-922), oil palm (Jalani et al. 1997, J Am Oil Chem Soc 74 1451-1455; Parveez, 2003, AgBiotechNet 113 1-8), Rice (Anai et al., 2003, Plant Cell Rep 21 988-992), Soybean (Reddy and Thomas, 1996, Nat Biotechnol 14 639-642; Kinney and Kwolton, 1998, Blackie Academic and Professional, London, pp 193-213), Sunflower (Arcadia, Biosciences 2008)

Carbohydrates, such as Fructans described for Chicory (Smeekens (1997) Trends Plant Sci 2 286-287, Sprenger et al. (1997) FEBS Lett 400 355-358, Sévenier et al. (1998) Nat Biotechnol 16 843-846), Maize (Caimi et al. (1996) Plant Physiol 110 355-363), Potato (Hellwege et al.,1997 Plant J 12 1057-1065), Sugar Beet (Smeekens et al. 1997, above), Inulin, such as described for Potato (Hellewege et al. 2000, Proc Natl Acad Sci USA 97 8699-8704), Starch, such as described for Rice (Schwall et al. (2000) Nat Biotechnol 18 551-554, Chiang et al. (2005) Mol Breed 15 125-143), Vitamins and carotenoids, such as described for Canola (Shintani and DellaPenna (1998) Science 282 2098-2100), Maize (Rocheford et al. (2002). J Am Coll Nutr 21 191S-198S, Cahoon et al. (2003) Nat Biotechnol 21 1082-1087, Chen et al. (2003) Proc Natl Acad Sci USA 100 3525-3530), Mustardseed (Shewmaker et al. (1999) Plant J 20 401-412, Potato (Ducreux et al., 2005, J Exp Bot 56 81-89), Rice (Ye et al. (2000) Science 287 303-305, Strawberry (Agius et al. (2003), Nat Biotechnol 21 177-181), Tomato (Rosati et al. (2000) Plant J 24 413-419, Fraser et al. (2001) J Sci Food Agric 81 822-827, Mehta et al. (2002) Nat Biotechnol 20 613-618, Diaz de la Garza et al. (2004) Proc Natl Acad Sci USA 101 13720-13725, Enfissi et al. (2005) Plant Biotechnol J 3 17-27, DellaPenna (2007) Proc Natl Acad Sci USA 104 3675-3676.

Functional secondary metabolites, such as described for Apple (stilbenes, Szankowski et al. (2003) Plant Cell Rep 22: 141-149), Alfalfa (resveratrol, Hipskind and Paiva (2000) Mol Plant Microbe Interact 13 551-562), Kiwi (resveratrol, Kobayashi et al. (2000) Plant Cell Rep 19 904-910), Maize and Soybean (flavonoids, Yu et al. (2000) Plant Physiol 124 781-794), Potato (anthocyanin and alkaloid glycoside, Lukaszewicz et al. (2004) J Agric Food Chem 52 1526-1533), Rice (flavonoids & resveratrol, Stark-Lorenzen et al. (1997) Plant Cell Rep 16 668-673, Shin et al. (2006) Plant Biotechnol J 4 303-315), Tomato (+resveratrol, chlorogenic acid, flavonoids, stilbene; Rosati et al. (2000) above, Muir et al. (2001) Nature 19 470-474, Niggeweg et al. (2004) Nat Biotechnol 22 746-754, Giovinazzo et al. (2005) Plant Biotechnol J 3 57-69), wheat (caffeic and ferulic acids, resveratrol; United Press International (2002)); and Mineral availabilities such as described for Alfalfa (phytase, Austin-Phillips et al. (1999) worldwideweb.molecularfarming.com/nonmedical.html), Lettuce (iron, Goto et al. (2000) Theor Appl Genet 100 658-664), Rice (iron, Lucca et al. (2002) J Am Coll Nutr 21 184S-190S), Maize, Soybean and wheate (phytase, Drakakaki et al. (2005) Plant Mol Biol 59 869-880, Denbow et al. (1998) Poult Sci 77 878-881, Brinch-Pedersen et al. (2000) Mol Breed 6 195-206).

In particular embodiments, the value-added trait is related to the envisaged health benefits of the compounds present in the plant. For instance, in particular embodiments, the value-added crop is obtained by applying the methods of the invention to ensure the modification of or induce/increase the synthesis of one or more of the following compounds:

Carotenoids, such as α-Carotene present in carrots which Neutralizes free radicals that may cause damage to cells or β-Carotene present in various fruits and vegetables which neutralizes free radicals Lutein present in green vegetables which contributes to maintenance of healthy vision Lycopene present in tomato and tomato products, which is believed to reduce the risk of prostate cancer Zeaxanthin, present in citrus and maize, which contributes to maintenance of healthy vision Dietary fiber such as insoluble fiber present in wheat bran which may reduce the risk of breast and/or colon cancer and β-Glucan present in oat, soluble fiber present in Psylium and whole cereal grains which may reduce the risk of cardiovascular disease (CVD)

Fatty acids, such as ω-3 fatty acids which may reduce the risk of CVD and improve mental and visual functions, Conjugated linoleic acid, which may improve body composition, may decrease risk of certain cancers and GLA which may reduce inflammation risk of cancer and CVD, may improve body composition Flavonoids such as Hydroxycinnamates, present in wheat which have Antioxidant-like activities, may reduce risk of degenerative diseases, flavonols, catechins and tannins present in fruits and vegetables which neutralize free radicals and may reduce risk of cancer Glucosinolates, indoles, isothiocyanates, such as Sulforaphane, present in Cruciferous vegetables (broccoli, kale), horseradish, which neutralize free radicals, may reduce risk of cancer Phenolics, such as stilbenes present in grape which May reduce risk of degenerative diseases, heart disease, and cancer, may have longevity effect and caffeic acid and ferulic acid present in vegetables and citrus which have Antioxidant-like activities, may reduce risk of degenerative diseases, heart disease, and eye disease, and epicatechin present in cacao which has Antioxidant-like activities, may reduce risk of degenerative diseases and heart disease Plant stanols/sterols present in maize, soy, wheat and wooden oils which May reduce risk of coronary heart disease by lowering blood cholesterol levels Fructans, inulins, fructo-oligosaccharides present in Jerusalem artichoke, shallot, onion powder which may improve gastrointestinal health Saponins present in soybean, which may lower LDL cholesterol Soybean protein present in soybean which may reduce risk of heart disease Phytoestrogens such as isoflavones present in soybean which May reduce menopause symptoms, such as hot flashes, may reduce osteoporosis and CVD and lignans present in flax, rye and vegetables, which May protect against heart disease and some cancers, may lower LDL cholesterol, total cholesterol.

Sulfides and thiols such as diallyl sulphide present in onion, garlic, olive, leek and scallon and Allyl methyl trisulfide, dithiolthiones present in cruciferous vegetables which may lower LDL cholesterol, helps to maintain healthy immune system Tannins, such as proanthocyanidins, present in cranberry, cocoa, which may improve urinary tract health, may reduce risk of CVD and high blood pressure Etc.

In addition, the methods of the present invention also envisage modifying protein/starch functionality, shelf life, taste/aesthetics, fiber quality, and allergen, antinutrient, and toxin reduction traits.

Accordingly, the invention encompasses methods for producing plants with nutritional added value, said methods comprising introducing into a plant cell a gene encoding an enzyme involved in the production of a component of added nutritional value using the Cpf1 CRISPR system as described herein and regenerating a plant from said plant cell, said plant characterized in an increase expression of said component of added nutritional value. In particular embodiments, the Cpf1 CRISPR system is used to modify the endogenous synthesis of these compounds indirectly, e.g. by modifying one or more transcription factors that controls the metabolism of this compound. Methods for introducing a gene of interest into a plant cell and/or modifying an endogenous gene using the Cpf1 CRISPR system are described herein above. Some specific examples of modifications in plants that have been modified to confer value-added traits are: plants with modified fatty acid metabolism, for example, by transforming a plant with an antisense gene of stearyl-ACP desaturase to increase stearic acid content of the plant. See Knultzon et al., Proc. Natl. Acad. Sci. U.S.A. 89:2624 (1992). Another example involves decreasing phytate content, for example by cloning and then reintroducing DNA associated with the single allele which may be responsible for maize mutants characterized by low levels of phytic acid. See Raboy et al, Maydica 35:383 (1990).

Similarly, expression of the maize (*Zea mays*) Tfs C1 and R, which regulate the production of flavonoids in maize aleurone layers under the control of a strong promoter, resulted in a high accumulation rate of anthocyanins in *Arabidopsis* (*Arabidopsis thaliana*), presumably by activating the entire pathway (Bruce et al., 2000, Plant Cell 12:65-80). DellaPenna (Welsch et al., 2007 Annu Rev Plant Biol 57: 711-738) found that Tf RAP2.2 and its interacting partner SINAT2 increased carotenogenesis in *Arabidopsis* leaves. Expressing the Tf Dof1 induced the up-regulation of genes encoding enzymes for carbon skeleton production, a marked increase of amino acid content, and a reduction of the Glc level in transgenic *Arabidopsis* (Yanagisawa, 2004 Plant Cell Physiol 45: 386-391), and the DOF Tf AtDof1.1 (OBP2) up-regulated all steps in the glucosinolate biosynthetic pathway in *Arabidopsis* (Skirycz et al., 2006 Plant J 47: 10-24).

Reducing Allergen in Plants

In particular embodiments the methods provided herein are used to generate plants with a reduced level of allergens, making them safer for the consumer. In particular embodiments, the methods comprise modifying expression of one or more genes responsible for the production of plant allergens. For instance, in particular embodiments, the methods comprise down-regulating expression of a Lol p5 gene in a plant cell, such as a ryegrass plant cell and regenerating a plant therefrom so as to reduce allergenicity of the pollen of said plant (Bhalla et al. 1999, Proc. Natl. Acad. Sci. USA Vol. 96: 11676-11680).

Peanut allergies and allergies to legumes generally are a real and serious health concern. The Cpf1 effector protein system of the present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3):222).

Screening Methods for Endogenous Genes of Interest

The methods provided herein further allow the identification of genes of value encoding enzymes involved in the production of a component of added nutritional value or generally genes affecting agronomic traits of interest, across species, phyla, and plant kingdom. By selectively targeting e.g. genes encoding enzymes of metabolic pathways in plants using the Cpf1 CRISPR system as described herein, the genes responsible for certain nutritional aspects of a plant can be identified. Similarly, by selectively targeting genes which may affect a desirable agronomic trait, the relevant genes can be identified. Accordingly, the present invention encompasses screening methods for genes encoding enzymes involved in the production of compounds with a particular nutritional value and/or agronomic traits.

Further Applications of the Cpf1 CRISPR System in Plants and Yeasts

Use of Cpf1 CRISPR System in Biofuel Production

The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the Cpf1 CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488). More particularly, the methods disclosed herein are used to generate mutations in homologs to Cas1L to reduce polysaccharide acetylation.

Modifying Yeast for Biofuel Production

In particular embodiments, the Cpf1 enzyme provided herein is used for bioethanol production by recombinant micro-organisms. For instance, Cpf1 can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the Cpf1 CRISPR complex is used to introduce foreign genes required for biofuel production into micro-organisms and/or to modify endogenous genes why may interfere with the biofuel synthesis. More particularly the methods involve introducing into a micro-organism such as a yeast one or more nucleotide sequence encoding enzymes involved in the conversion of pyruvate to ethanol or another product of interest. In particular embodiments the methods ensure the introduction of one or more enzymes which allows the micro-organism to degrade cellulose, such as a cellulase. In yet further embodiments, the Cpf1 CRISPR complex is used to modify endogenous metabolic pathways which compete with the biofuel production pathway.

Accordingly, in more particular embodiments, the methods described herein are used to modify a micro-organism as follows:

to introduce at least one heterologous nucleic acid or increase expression of at least one endogenous nucleic acid encoding a plant cell wall degrading enzyme, such that said micro-organism is capable of expressing said nucleic acid and of producing and secreting said plant cell wall degrading enzyme;

to introduce at least one heterologous nucleic acid or increase expression of at least one endogenous nucleic acid encoding an enzyme that converts pyruvate to acetaldehyde optionally combined with at least one heterologous nucleic acid encoding an enzyme that converts acetaldehyde to ethanol such that said host cell is capable of expressing said nucleic acid; and/or to modify at least one nucleic acid encoding for an enzyme in a metabolic pathway in said host cell, wherein said pathway produces a metabolite other than acetaldehyde from pyruvate or ethanol from acetaldehyde, and wherein said modification results in a reduced production of said metabolite, or to introduce at least one nucleic acid encoding for an inhibitor of said enzyme.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

According to particular embodiments of the invention, the Cpf1 CRISPR system is used to generate lipid-rich diatoms which are useful in biofuel production.

In particular embodiments it is envisaged to specifically modify genes that are involved in the modification of the quantity of lipids and/or the quality of the lipids produced by the algal cell. Examples of genes encoding enzymes involved in the pathways of fatty acid synthesis can encode proteins having for instance acetyl-CoA carboxylase, fatty acid synthase, 3-ketoacyl_acyl-carrier protein synthase III, glycerol-3-phospate deshydrogenase (G3PDH), Enoyl-acyl carrier protein reductase (Enoyl-ACP-reductase), glycerol-3-phosphate acyltransferase, lysophosphatidic acyl transferase or diacylglycerol acyltransferase, phospholipid:diacylglycerol acyltransferase, phoshatidate phosphatase, fatty acid thioesterase such as palmitoyi protein thioesterase, or malic enzyme activities. In further embodiments it is envisaged to generate diatoms that have increased lipid accumulation. This can be achieved by targeting genes that decrease lipid catabolisation. Of particular interest for use in the methods of the present invention are genes involved in the activation of both triacylglycerol and free fatty acids, as well as genes directly involved in β-oxidation of fatty acids, such as acyl-CoA synthetase, 3-ketoacyl-CoA thiolase, acyl-CoA oxidase activity and phosphoglucomutase. The Cpf1 CRISPR system and methods described herein can be used to specifically activate such genes in diatoms as to increase their lipid content.

Organisms such as microalgae are widely used for synthetic biology. Stovicek et al. (Metab. Eng. Comm., 2015; 2:13 describes genome editing of industrial yeast, for example, *Saccharomyces cerevisae*, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2µ-based vector locations. The authors also showed that gene disruption efficiency could be improved by optimization of the levels of Cas9 and gRNA expression. Hlavovi et al. (Biotechnol. Adv. 2015) discusses development of species or strains of microalgae using techniques such as CRISPR to target nuclear and chloroplast genes for insertional mutagenesis and screening. The methods of Stovicek and Hlavová may be applied to the Cpf1 effector protein system of the present invention. U.S. Pat. No. 8,945,839 describes a method for engineering Micro-Algae (*Chlamydomonas reinhardtii* cells) species) using Cas9. Using similar tools, the methods of the Cpf1 CRISPR system described herein can be applied on *Chlamydomonas* species and other algae. In particular embodiments, Cpf1 and guide RNA are introduced in algae expressed using a vector that expresses Cpf1 under the control of a constitutive promoter such as Hsp70A-Rbc S2 or Beta2-tubulin. Guide RNA will be delivered using a vector containing T7 promoter. Alternatively, Cpf1 mRNA and in vitro transcribed guide RNA can be delivered to algal cells. Electroporation protocol follows standard recommended protocol from the GeneArt *Chlamydomonas* Engineering kit.

The Use of Cpf1 in the Generation of Micro-Organisms Capable of Fatty Acid Production In particular embodiments, the methods of the invention are used for the generation of genetically engineered micro-organisms capable of the production of fatty esters, such as fatty acid methyl esters ("FAME") and fatty acid ethyl esters ("FAEE"), Typically, host cells can be engineered to produce fatty esters from a carbon source, such as an alcohol, present in the medium, by expression or overexpression of a gene encoding a thioesterase, a gene encoding an acyl-CoA synthase, and a gene encoding an ester synthase. Accordingly, the methods provided herein are used to modify a micro-organisms so as to overexpress or introduce a thioesterase gene, a gene encloding an acyl-CoA synthase, and a gene encoding an ester synthase. In particular embodiments, the thioesterase gene is selected from tesA, 'tesA, tesB, fatB, fatB2, fatB3, fatA1, or fatA. In particular embodiments, the gene encoding an acyl-CoA synthase is selected from fadDJadK, BH3103, pfl-4354, EAV15023, fadD1, fadD2, RPC_4074, fadDD35, fadDD22, faa39, or an identified gene encoding an enzyme having the same properties. In particular embodiments, the gene encoding an ester synthase is a gene encoding a synthase/acyl-CoA:diacylglycerl acyltransferase from *Simmondsia chinensis, Acinetobacter* sp. ADP, *Alcanivorax borkumensis, Pseudomonas aeruginosa, Fundibacter jadensis, Arabidopsis thaliana*, or *Alkaligenes eutrophus*, or a variant thereof. Additionally or alternatively, the methods provided herein are used to decrease expression in said micro-organism of at least one of a gene encoding an acyl-CoA dehydrogenase, a gene encoding an outer membrane protein receptor, and a gene encoding a transcriptional regulator of fatty acid biosynthesis. In particular embodiments one or more of these genes is inactivated, such as by introduction of a mutation. In particular embodiments, the gene encoding an acyl-CoA dehydrogenase is fadE. In particular embodiments, the gene encoding a transcriptional regulator of fatty acid biosynthesis encodes a DNA transcription repressor, for example, fabR.

Additionally or alternatively, said micro-organism is modified to reduce expression of at least one of a gene encoding a pyruvate formate lyase, a gene encoding a lactate dehydrogenase, or both. In particular embodiments, the gene encoding a pyruvate formate lyase is pflB. In particular embodiments, the gene encoding a lactate dehydrogenase is IdhA. In particular embodiments one or more of these genes is inactivated, such as by introduction of a mutation therein.

In particular embodiments, the micro-organism is selected from the genus *Escherichia, Bacillus, Lactobacillus, Rhodococcus, Synechococcus, Synechoystis, Pseudomonas, Aspergillus, Trichoderma, Neurospora, Fusarium, Humicola, Rhizomucor, Kluyveromyces, Pichia, Mucor, Mycelio-phtora, Penicillium, Phanerochaete, Pleurotus, Trametes, Chrysosporium, Saccharomyces, Stenotrophamonas, Schizosaccharomyces, Yarrowia*, or *Streptomyces*.

The Use of Cpf1 in the Generation of Micro-Organisms Capable of Organic Acid Production The methods provided herein are further used to engineer micro-organisms capable of organic acid production, more particularly from pentose or hexose sugars. In particular embodiments, the methods comprise introducing into a micro-organism an exogenous LDH gene. In particular embodiments, the organic acid production in said micro-organisms is additionally or alternatively increased by inactivating endogenous genes encoding proteins involved in an endogenous metabolic pathway which produces a metabolite other than the organic acid of interest and/or wherein the endogenous metabolic pathway consumes the organic acid. In particular embodiments, the modification ensures that the production of the metabolite other than the organic acid of interest is reduced. According to particular embodiments, the methods are used to introduce at least one engineered gene deletion and/or inactivation of an endogenous pathway in which the organic acid is consumed or a gene encoding a product involved in an endogenous pathway which produces a metabolite other than the organic acid of interest. In particular embodiments, the at least one engineered gene deletion or inactivation is in one or more gene encoding an enzyme selected from the group consisting of pyruvate decarboxylase (pdc), fumarate reductase, alcohol dehydrogenase (adh), acetaldehyde dehydrogenase, phosphoenolpyruvate carboxylase (ppc), D-lactate dehydrogenase (d-ldh), L-lactate dehydrogenase (l-ldh), lactate 2-monooxygenase.

In further embodiments the at least one engineered gene deletion and/or inactivation is in an endogenous gene encoding pyruvate decarboxylase (pdc).

In further embodiments, the micro-organism is engineered to produce lactic acid and the at least one engineered gene deletion and/or inactivation is in an endogenous gene encoding lactate dehydrogenase. Additionally or alternatively, the micro-organism comprises at least one engineered gene deletion or inactivation of an endogenous gene encoding a cytochrome-dependent lactate dehydrogenase, such as a cytochrome B2-dependent L-lactate dehydrogenase.

The Use of Cpf1 in the Generation of Improved Xylose or Cellobiose Utilizing Yeasts Strains In particular embodiments, the Cpf1 CRISPR system may be applied to select for improved xylose or cellobiose utilizing yeast strains. Error-prone PCR can be used to amplify one (or more) genes involved in the xylose utilization or cellobiose utilization pathways. Examples of genes involved in xylose utilization pathways and cellobiose utilization pathways may include, without limitation, those described in Ha, S. J., et al. (2011) Proc. Natl. Acad. Sci. USA 108(2):504-9 and Galazka, J. M., et al. (2010) Science 330(6000):84-6. Resulting libraries of double-stranded DNA molecules, each comprising a random mutation in such a selected gene could be co-transformed with the components of the Cpf1 CRISPR system into a yeast strain (for instance S288C) and strains can be selected with enhanced xylose or cellobiose utilization capacity, as described in WO2015138855.

The Use of Cpf1 in the Generation of Improved Yeasts Strains for Use in Isoprenoid Biosynthesis Tadas Jakočiūnas et al. described the successful application of a multiplex CRISPR/Cas9 system for genome engineering of up to 5 different genomic loci in one transformation step in baker's yeast *Saccharomyces cerevisiae* (Metabolic Engineering Volume 28, March 2015, Pages 213-222) resulting in strains with high mevalonate production, a key intermediate for the industrially important isoprenoid biosynthesis pathway. In particular embodiments, the Cpf1 CRISPR system may be applied in a multiplex genome engineering method as described herein for identifying additional high producing yeast strains for use in isoprenoid synthesis.

The Use of Cpf1 in the Generation of Lactic Acid Producing Yeasts Strains

In another embodiment, successful application of a multiplex Cpf1 CRISPR system is encompassed. In analogy with Vratislav Stovicek et al. (Metabolic Engineering Communications, Volume 2, December 2015, Pages 13-22), improved lactic acid-producing strains can be designed and obtained in a single transformation event. In a particular embodiment, the Cpf1 CRISPR system is used for simultaneously inserting the heterologous lactate dehydrogenase gene and disruption of two endogenous genes PDC1 and PDC5 genes.

Further Applications of the Cpf1 CRISPR System in Plants

In particular embodiments, the CRISPR system, and preferably the Cpf1 CRISPR system described herein, can be used for visualization of genetic element dynamics. For example, CRISPR imaging can visualize either repetitive or non-repetitive genomic sequences, report telomere length change and telomere movements and monitor the dynamics of gene loci throughout the cell cycle (Chen et al., Cell, 2013). These methods may also be applied to plants.

Other applications of the CRISPR system, and preferably the Cpf1 CRISPR system described herein, is the targeted gene disruption positive-selection screening in vitro and in vivo (Malina et al., Genes and Development, 2013). These methods may also be applied to plants.

In particular embodiments, fusion of inactive Cpf1 endonucleases with histone-modifying enzymes can introduce custom changes in the complex epigenome (Rusk et al., Nature Methods, 2014). These methods may also be applied to plants.

In particular embodiments, the CRISPR system, and preferably the Cpf1 CRISPR system described herein, can be used to purify a specific portion of the chromatin and identify the associated proteins, thus elucidating their regulatory roles in transcription (Waldrip et al., Epigenetics, 2014). These methods may also be applied to plants.

In particular embodiments, present invention can be used as a therapy for virus removal in plant systems as it is able to cleave both viral DNA and RNA. Previous studies in human systems have demonstrated the success of utilizing CRISPR in targeting the single strand RNA virus, hepatitis C (A. Price, et al., Proc. Natl. Acad. Sci, 2015) as well as the double stranded DNA virus, hepatitis B (V. Ramanan, et al., Sci. Rep, 2015). These methods may also be adapted for using the Cpf1 CRISPR system in plants.

In particular embodiments, present invention could be used to alter genome complexity. In further particular embodiment, the CRISPR system, and preferably the Cpf1 CRISPR system described herein, can be used to disrupt or alter chromosome number and generate haploid plants, which only contain chromosomes from one parent. Such plants can be induced to undergo chromosome duplication and converted into diploid plants containing only homozygous alleles (Karimi-Ashtiyani et al., PNAS, 2015; Anton et al., Nucleus, 2014). These methods may also be applied to plants.

In particular embodiments, the Cpf1 CRISPR system described herein, can be used for self-cleavage. In these embodiments, the promotor of the Cpf1 enzyme and gRNA can be a constitutive promotor and a second gRNA is introduced in the same transformation cassette, but controlled by an inducible promoter. This second gRNA can be designated to induce site-specific cleavage in the Cpf1 gene in order to create a non-functional Cpf1. In a further particular embodiment, the second gRNA induces cleavage on both ends of the transformation cassette, resulting in the removal of the cassette from the host genome. This system offers a controlled duration of cellular exposure to the Cas enzyme and further minimizes off-target editing. Furthermore, cleavage of both ends of a CRISPR/Cas cassette can be used to generate transgene-free T0 plants with bi-allelic mutations (as described for Cas9 e.g. Moore et al., Nucleic Acids Research, 2014; Schaeffer et al., Plant Science, 2015). The methods of Moore et al. may be applied to the Cpf1 CRISPR systems described herein. Sugano et al. (Plant Cell Physiol. 2014 March; 55(3):475-81. doi: 10.1093/pcp/pcu014. Epub 2014 Jan. 18) reports the application of CRISPR-Cas9 to targeted mutagenesis in the liverwort *Marchantia polymorpha* L., which has emerged as a model species for studying land plant evolution. The U6 promoter of *M. polymorpha* was identified and cloned to express the gRNA. The target sequence of the gRNA was designed to disrupt the gene encoding auxin response factor 1 (ARF1) in *M. polymorpha*. Using *Agrobacterium*-mediated transformation, Sugano et al. isolated stable mutants in the gametophyte generation of *M. polymorpha*. CRISPR-Cas9-based site-directed mutagenesis in vivo was achieved using either the Cauliflower mosaic virus 35S or *M. polymorpha* EF1α promoter to express Cas9. Isolated mutant individuals showing an auxin-resistant phenotype were not chimeric. Moreover, stable mutants were produced by asexual reproduction of T1 plants. Multiple arf1 alleles were easily established using CRIPSR-Cas9-based targeted mutagenesis. The methods of Sugano et al. may be applied to the Cpf1 effector protein system of the present invention.

Kabadi et al. (Nucleic Acids Res. 2014 Oct. 29; 42(19): e147. doi: 10.1093/nar/gku749. Epub 2014 Aug. 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The methods of Kabadi et al. may be applied to the Cpf1 effector protein system of the present invention.

Ling et al. (BMC Plant Biology 2014, 14:327) developed a CRISPR-Cas9 binary vector set based on the pGreen or pCAMBIA backbone, as well as a gRNA This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic *Arabidopsis* lines and was shown to exhibit high efficiency and specificity. More importantly, using this toolkit, targeted mutations of three *Arabidopsis* genes were detected in transgenic seedlings of the T1 generation. Moreover, the multiple-gene mutations could be inherited by the next generation. (guide RNA)module vector set, as a toolkit for multiplex genome editing in plants. The toolbox of Lin et al. may be applied to the Cpf1 effector protein system of the present invention.

Protocols for targeted plant genome editing via CRISPR-Cpf1 are also available based on those disclosed for the CRISPR-Cas9 system in volume 1284 of the series Methods in Molecular Biology pp 239-255 10 Feb. 2015. A detailed procedure to design, construct, and evaluate dual gRNAs for plant codon optimized Cas9 (pcoCas9) mediated genome editing using *Arabidopsis thaliana* and *Nicotiana benthamiana* protoplasts s model cellular systems are described. Strategies to apply the CRISPR-Cas9 system to generating targeted genome modifications in whole plants are also discussed. The protocols described in the chapter may be applied to the Cpf1 effector protein system of the present invention.

Petersen ("Towards precisely glycol engineered plants," Plant Biotech Denmark Annual meeting 2015, Copenhagen, Denmark) developed a method of using CRISPR/Cas9 to engineer genome changes in *Arabidopsis*, for example to glyco engineer *Arabidopsis* for production of proteins and products having desired posttranslational modifications. Hebelstrup et al. (Front Plant Sci. 2015 Apr. 23; 6:247) outlines in planta starch bioengineering, providing crops that express starch modifying enzymes and directly produce products that normally are made by industrial chemical and/or physical treatments of starches. The methods of Petersen and Hebelstrup may be applied to the Cpf1 effector protein system of the present invention.

Ma et al. (Mol Plant. 2015 Aug. 3; 8(8):1274-84. doi: 10.1016/j.molp.2015.04.007) reports robust CRISPR-Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR-Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in T0 rice and T1Arabidopsis plants by simultaneous targeting of multiple (up to eight) members of a gene family, multiple genes in a biosynthetic pathway, or multiple sites in a single gene. The methods of Ma et al. may be applied to the Cpf1 effector protein system of the present invention.

Lowder et al. (Plant Physiol. 2015 Aug. 21. pii: pp. 00636.2015) also developed a CRISPR-Cas9 toolbox enables multiplex genome editing and transcriptional regulation of expressed, silenced or non-coding genes in plants. This toolbox provides researchers with a protocol and reagents to quickly and efficiently assemble functional CRISPR-Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modem plant biotechnology, genetics, molecular biology and physiology. As such, Applicants developed a method for the assembly of Cas9 (WT, nickase or dCas9) and gRNA(s) into a T-DNA destination-vector of interest. The assembly method is based on both Golden Gate assembly and MultiSite Gateway recombination. Three modules are required for assembly. The first module is a Cas9 entry vector, which contains promoterless Cas9 or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for Cas9 expression. The toolbox of Lowder et al. may be applied to the Cpf1 effector protein system of the present invention.

In an advantageous embodiment, the plant may be a tree. The present invention may also utilize the herein disclosed CRISPR Cas system for herbaceous systems (see, e.g., Belhaj et al., Plant Methods 9: 39 and Harrison et al., Genes & Development 28: 1859-1872). In a particularly advantageous embodiment, the CRISPR Cas system of the present invention may target single nucleotide polymorphisms (SNPs) in trees (see, e.g., Zhou et al., New Phytologist, Volume 208, Issue 2, pages 298-301, October 2015). In the Zhou et al. study, the authors applied a CRISPR Cas system in the woody perennial *Populus* using the 4-coumarate:CoA ligase (4CL) gene family as a case study and achieved 100% mutational efficiency for two 4CL genes targeted, with every transformant examined carrying biallelic modifications. In the Zhou et al., study, the CRISPR-Cas9 system was highly sensitive to single nucleotide polymorphisms (SNPs), as cleavage for a third 4CL gene was abolished due to SNPs in the target sequence. These methods may be applied to the Cpf1 effector protein system of the present invention.

The methods of Zhou et al. (New Phytologist, Volume 208, Issue 2, pages 298-301, October 2015) may be applied to the present invention as follows. Two 4CL genes, 4CL1 and 4CL2, associated with lignin and flavonoid biosynthesis, respectively are targeted for CRISPR-Cas9 editing. The *Populus tremula*×alba clone 717-1B4 routinely used for transformation is divergent from the genome-sequenced *Populus trichocarpa*. Therefore, the 4CL1 and 4CL2 gRNAs designed from the reference genome are interrogated with in-house 717 RNA-Seq data to ensure the absence of SNPs which could limit Cas efficiency. A third gRNA designed for 4CL5, a genome duplicate of 4CL1, is also included. The corresponding 717 sequence harbors one SNP in each allele near/within the PAM, both of which are expected to abolish targeting by the 4CL5-gRNA. All three gRNA target sites are located within the first exon. For 717 transformation, the gRNA is expressed from the *Medicago* U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data is then processed and biallelic mutations are confirmed in all cases. These methods may be applied to the Cpf1 effector protein system of the present invention.

In plants, pathogens are often host-specific. For example, *Fusarium oxysporum* f. sp. *lycopersici* causes tomato wilt but attacks only tomato, and *F. oxysporumf dianthii Puccinia graminis* f. sp. *tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

Improved Plants and Yeast Cells

The present invention also provides plants and yeast cells obtainable and obtained by the methods provided herein. The improved plants obtained by the methods described herein may be useful in food or feed production through expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants.

Cpf1 Effector Protein Complexes can be Used in Non-Human Organisms/Animals

In an aspect, the invention provides a non-human eukaryotic organism; preferably a multicellular eukaryotic organism, comprising a eukaryotic host cell according to any of the described embodiments. In other aspects, the invention provides a eukaryotic organism; preferably a multicellular eukaryotic organism, comprising a eukaryotic host cell according to any of the described embodiments. The organism in some embodiments of these aspects may be an animal; for example a mammal. Also, the organism may be an arthropod such as an insect. The organism also may be a plant. Further, the organism may be a fungus.

The present invention may also be extended to other agricultural applications such as, for example, farm and production animals. For example, pigs have many features that make them attractive as biomedical models, especially in regenerative medicine. In particular, pigs with severe combined immunodeficiency (SCID) may provide useful models for regenerative medicine, xenotransplantation (discussed also elsewhere herein), and tumor development and will aid in developing therapies for human SCID patients. Lee et al., (Proc Natl Acad Sci USA. 2014 May 20; 111(20):7260-5) utilized a reporter-guided transcription activator-like effector nuclease (TALEN) system to generated targeted modifications of recombination activating gene (RAG) 2 in somatic cells at high efficiency, including some that affected both alleles. The Cpf1 effector protein may be applied to a similar system.

The methods of Lee et al., (Proc Natl Acad Sci USA. 2014 May 20; 111(20):7260-5) may be applied to the present invention analogously as follows. Mutated pigs are produced by targeted modification of RAG2 in fetal fibroblast cells followed by SCNT and embryo transfer. Constructs coding for CRISPR Cas and a reporter are electroporated into fetal-derived fibroblast cells. After 48 h, transfected cells expressing the green fluorescent protein are sorted into individual wells of a 96-well plate at an estimated dilution of a single cell per well. Targeted modification of RAG2 are screened by amplifying a genomic DNA fragment flanking any CRISPR Cas cutting sites followed by sequencing the PCR products. After screening and ensuring lack of off-site mutations, cells carrying targeted modification of RAG2 are used for SCNT. The polar body, along with a portion of the adjacent cytoplasm of oocyte, presumably containing the metaphase II plate, are removed, and a donor cell are placed in the perivitelline. The reconstructed embryos are then electrically porated to fuse the donor cell with the oocyte and then chemically activated. The activated embryos are incubated in Porcine Zygote Medium 3 (PZM3) with 0.5 µM Scriptaid (S7817; Sigma-Aldrich) for 14-16 h. Embryos are then washed to remove the Scriptaid and cultured in PZM3 until they were transferred into the oviducts of surrogate pigs.

The present invention is also applicable to modifying SNPs of other animals, such as cows. Tan et al. (Proc Natl Acad Sci USA. 2013 Oct. 8; 110(41): 16526-16531)

expanded the livestock gene editing toolbox to include transcription activator-like (TAL) effector nuclease (TALEN)- and clustered regularly interspaced short palindromic repeats (CRISPR)/Cas9-stimulated homology-directed repair (HDR) using plasmid, rAAV, and oligonucleotide templates. Gene specific gRNA sequences were cloned into the Church lab gRNA vector (Addgene ID: 41824) according to their methods (Mali P, et al. (2013) RNA-Guided Human Genome Engineering via Cas9. Science 339(6121):823-826). The Cas9 nuclease was provided either by co-transfection of the hCas9 plasmid (Addgene ID: 41815) or mRNA synthesized from RCIScript-hCas9. This RCIScript-hCas9 was constructed by sub-cloning the XbaI-AgeI fragment from the hCas9 plasmid (encompassing the hCas9 cDNA) into the RCIScript plasmid.

Heo et al. (Stem Cells Dev. 2015 Feb. 1; 24(3):393-402. doi: 10.1089/scd.2014.0278. Epub 2014 Nov. 3) reported highly efficient gene targeting in the bovine genome using bovine pluripotent cells and clustered regularly interspaced short palindromic repeat (CRISPR)/Cas9 nuclease. First, Heo et al. generate induced pluripotent stem cells (iPSCs) from bovine somatic fibroblasts by the ectopic expression of yamanaka factors and GSK3β and MEK inhibitor (2i) treatment. Heo et al. observed that these bovine iPSCs are highly similar to naïve pluripotent stem cells with regard to gene expression and developmental potential in teratomas. Moreover, CRISPR-Cas9 nuclease, which was specific for the bovine NANOG locus, showed highly efficient editing of the bovine genome in bovine iPSCs and embryos.

Igenity® provides a profile analysis of animals, such as cows, to perform and transmit traits of economic traits of economic importance, such as carcass composition, carcass quality, maternal and reproductive traits and average daily gain. The analysis of a comprehensive Igenity® profile begins with the discovery of DNA markers (most often single nucleotide polymorphisms or SNPs). All the markers behind the Igenity® profile were discovered by independent scientists at research institutions, including universities, research organizations, and government entities such as USDA. Markers are then analyzed at Igenity® in validation populations. Igenity® uses multiple resource populations that represent various production environments and biological types, often working with industry partners from the seedstock, cow-calf, feedlot and/or packing segments of the beef industry to collect phenotypes that are not commonly available. Cattle genome databases are widely available, see, e.g., the NAGRP Cattle Genome Coordination Program (worldwideweb.animalgenome.org/cattle/maps/db.html).

Thus, the present invention maybe applied to target bovine SNPs. One of skill in the art may utilize the above protocols for targeting SNPs and apply them to bovine SNPs as described, for example, by Tan et al. or Heo et al.

Qingjian Zou et al. (Journal of Molecular Cell Biology Advance Access published Oct. 12, 2015) demonstrated increased muscle mass in dogs by targeting the first exon of the dog Myostatin (MSTN) gene (a negative regulator of skeletal muscle mass). First, the efficiency of the sgRNA was validated, using cotransfection of the sgRNA targeting MSTN with a Cas9 vector into canine embryonic fibroblasts (CEFs). Thereafter, MSTN KO dogs were generated by micro-injecting embryos with normal morphology with a mixture of Cas9 mRNA and MSTN sgRNA and auto-transplantation of the zygotes into the oviduct of the same female dog. The knock-out puppies displayed an obvious muscular phenotype on thighs compared with its wild-type littermate sister. This can also be performed using the Cpf1 CRISPR systems provided herein.

Livestock—Pigs

Viral targets in livestock may include, in some embodiments, porcine CD163, for example on porcine macrophages. CD163 is associated with infection (thought to be through viral cell entry) by PRRSv (Porcine Reproductive and Respiratory Syndrome virus, an arterivirus). Infection by PRRSv, especially of porcine alveolar macrophages (found in the lung), results in a previously incurable porcine syndrome ("Mystery swine disease" or "blue ear disease") that causes suffering, including reproductive failure, weight loss and high mortality rates in domestic pigs. Opportunistic infections, such as enzootic pneumonia, meningitis and ear oedema, are often seen due to immune deficiency through loss of macrophage activity. It also has significant economic and environmental repercussions due to increased antibiotic use and financial loss (an estimated $660m per year).

As reported by Kristin M Whitworth and Dr Randall Prather et al. (Nature Biotech 3434 published online 7 Dec. 2015) at the University of Missouri and in collaboration with Genus Plc, CD163 was targeted using CRISPR-Cas9 and the offspring of edited pigs were resistant when exposed to PRRSv. One founder male and one founder female, both of whom had mutations in exon 7 of CD163, were bred to produce offspring. The founder male possessed an 11-bp deletion in exon 7 on one allele, which results in a frameshift mutation and missense translation at amino acid 45 in domain 5 and a subsequent premature stop codon at amino acid 64. The other allele had a 2-bp addition in exon 7 and a 377-bp deletion in the preceding intron, which were predicted to result in the expression of the first 49 amino acids of domain 5, followed by a premature stop code at amino acid 85. The sow had a 7 bp addition in one allele that when translated was predicted to express the first 48 amino acids of domain 5, followed by a premature stop codon at amino acid 70. The sow's other allele was unamplifiable. Selected offspring were predicted to be a null animal (CD163−/−), i.e. a CD163 knock out.

Accordingly, in some embodiments, porcine alveolar macrophages may be targeted by the CRISPR protein. In some embodiments, porcine CD163 may be targeted by the CRISPR protein. In some embodiments, porcine CD163 may be knocked out through induction of a DSB or through insertions or deletions, for example targeting deletion or modification of exon 7, including one or more of those described above, or in other regions of the gene, for example deletion or modification of exon 5.

An edited pig and its progeny are also envisaged, for example a CD163 knock out pig. This may be for livestock, breeding or modelling purposes (i.e. a porcine model). Semen comprising the gene knock out is also provided.

CD163 is a member of the scavenger receptor cysteine-rich (SRCR) superfamily. Based on in vitro studies SRCR domain 5 of the protein is the domain responsible for unpackaging and release of the viral genome. As such, other members of the SRCR superfamily may also be targeted in order to assess resistance to other viruses. PRRSV is also a member of the mammalian arterivirus group, which also includes murine lactate dehydrogenase-elevating virus, simian hemorrhagic fever virus and equine arteritis virus. The arteriviruses share important pathogenesis properties, including macrophage tropism and the capacity to cause both severe disease and persistent infection. Accordingly, arteriviruses, and in particular murine lactate dehydrogenase-elevating virus, simian hemorrhagic fever virus and equine arteritis virus, may be targeted, for example through porcine CD163 or homologues thereof in other species, and murine, simian and equine models and knockout also provided.

Indeed, this approach may be extended to viruses or bacteria that cause other livestock diseases that may be transmitted to humans, such as Swine Influenza Virus (SIV) strains which include influenza C and the subtypes of influenza A known as H1N1, H1N2, H2N1, H3N1, H3N2, and H2N3, as well as pneumonia, meningitis and oedema mentioned above.

Therapeutic Targeting with RNA-Guided Cpf1 Effector Protein Complex

As will be apparent, it is envisaged that the present system can be used to target any polynucleotide sequence of interest. The invention provides a non-naturally occurring or engineered composition, or one or more polynucleotides encoding components of said composition, or vector or delivery systems comprising one or more polynucleotides encoding components of said composition for use in a modifying a target cell in vivo, ex vivo or in vitro and, may be conducted in a manner alters the cell such that once modified the progeny or cell line of the CRISPR modified cell retains the altered phenotype. The modified cells and progeny may be part of a multi-cellular organism such as a plant or animal with ex vivo or in vivo application of CRISPR system to desired cell types. The CRISPR invention may be a therapeutic method of treatment. The therapeutic method of treatment may comprise gene or genome editing, or gene therapy.

Treating Pathogens, Like Bacterial, Fungal and Parasitic Pathogens

The present invention may also be applied to treat bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria.

Jiang et al. ("RNA-guided editing of bacterial genomes using CRISPR-Cas systems," Nature Biotechnology vol. 31, p. 233-9, March 2013) used a CRISPR-Cas9 system to mutate or kill *S. pneumoniae* and *E. coli*. The work, which introduced precise mutations into the genomes, relied on dual-RNA:Cas9-directed cleavage at the targeted genomic site to kill unmutated cells and circumvented the need for selectable markers or counter-selection systems. CRISPR systems have be used to reverse antibiotic resistance and eliminate the transfer of resistance between strains. Bickard et al. showed that Cas9, reprogrammed to target virulence genes, kills virulent, but not avirulent, *S. aureus*. Reprogramming the nuclease to target antibiotic resistance genes destroyed staphylococcal plasmids that harbor antibiotic resistance genesand immunized against the spread of plasmid-borne resistance genes. (see, Bikard et al., "Exploiting CRISPR-Cas nucleases to produce sequence-specific antimicrobials," Nature Biotechnology vol. 32, 1146-1150, doi: 10.1038/nbt.3043, published online 5 Oct. 2014.) Bikard showed that CRISPR-Cas9 antimicrobials function in vivo to kill *S. aureus* in a mouse skin colonization model. Similarly, Yosef et al used a CRISPR system to target genes encoding enzymes that confer resistance to β-lactam antibiotics (see Yousef et al., "Temperate and lytic bacteriophages programmed to sensitize and kill antibiotic-resistant bacteria," Proc. Natl. Acad. Sci. USA, vol. 112, p. 7267-7272, doi: 10.1073/pnas.1500107112 published online May 18, 2015).

CRISPR systems can be used to edit genomes of parasites that are resistant to other genetic approaches. For example, a CRISPR-Cas9 system was shown to introduce double-stranded breaks into the in the *Plasmodium yoelii* genome (see, Zhang et al., "Efficient Editing of Malaria Parasite Genome Using the CRISPR/Cas9 System," mBio. vol. 5, e01414-14, July-August 2014). Ghorbal et al. ("Genome editing in the human malaria parasite *Plasmodium* falciparumusing the CRISPR-Cas9 system," Nature Biotechnology, vol. 32, p. 819-821, doi: 10.1038/nbt.2925, published online Jun. 1, 2014) modified the sequences of two genes, orc1 and kelch13, which have putative roles in gene silencing and emerging resistance to artemisinin, respectively. Parasites that were altered at the appropriate sites were recovered with very high efficiency, despite there being no direct selection for the modification, indicating that neutral or even deleterious mutations can be generated using this system. CRISPR-Cas9 is also used to modify the genomes of other pathogenic parasites, including *Toxoplasma gondii* (see Shen et al., "Efficient gene disruption in diverse strains of *Toxoplasma gondii* using CRISPR/CAS9," mBio vol. 5:e01114-14, 2014; and Sidik et al., "Efficient Genome Engineering of *Toxoplasma gondii* Using CRISPR/Cas9," PLoS One vol. 9, e100450, doi: 10.1371/journal.pone.0100450, published online Jun. 27, 2014).

Vyas et al. ("A *Candida albicans* CRISPR system permits genetic engineering of essential genes and gene families," Science Advances, vol. 1, e1500248, DOI: 10.1 126/sciadv.1500248, Apr. 3, 2015) employed a CRISPR system to overcome long-standing obstacles to genetic engineering in *C. albicans* and efficiently mutate in a single experiment both copies of several different genes. In an organism where several mechanisms contribute to drug resistance, Vyas produced homozygous double mutants that no longer displayed the hyper-resistance to fluconazole or cycloheximide displayed by the parental clinical isolate Can90. Vyas also obtained homozygous loss-of-function mutations in essential genes of *C. albicans* by creating conditional alleles. Null alleles of DCR1, which is required for ribosomal RNA processing, are lethal at low temperature but viable at high temperature. Vyas used a repair template that introduced a nonsense mutation and isolated dcr1/dcr1 mutants that failed to grow at 16° C.

The CRISPR system of the present invention for use in *P. falciparum* by disrupting chromosomal loci. Ghorbal et al. ("Genome editing in the human malaria parasite *Plasmodium falciparum* using the CRISPR-Cas9 system", Nature Biotechnology, 32, 819-821 (2014), DOI: 10.1038/nbt.2925, Jun. 1, 2014) employed a CRISPR system to introduce specific gene knockouts and single-nucleotide substitutions in the malaria genome. To adapt the CRISPR-Cas9 system to *P. falciparum*, Ghorbal et al. generated expression vectors for under the control of plasmodial regulatory elements in the pUF1-Cas9 episome that also carries the drug-selectable marker ydhodh, which gives resistance to DSM1, a *P. falciparum* dihydroorotate dehydrogenase (PfDHODH) inhibitor and for transcription of the sgRNA, used *P. falciparum* U6 small nuclear (sn)RNA regulatory elements placing the guide RNA and the donor DNA template for homologous recombination repair on the same plasmid, pL7. See also, Zhang C. et al. ("Efficient editing of malaria parasite genome using the CRISPR/Cas9 system", MBio, 2014 Jul. 1; 5(4):E01414-14, doi: 10.1128/MbIO.01414-14) and Wagner et al. ("Efficient CRISPR-Cas9-mediated genome edit- Treating Pathogens, Like Viral Pathogens Such as HIV Cas-mediated genome editing might be used to introduce protective mutations in somatic tissues to combat nongenetic or complex diseases. For example, NHEJ-mediated inactivation of the CCR5 receptor in lymphocytes (Lombardo et al., Nat Biotechnol. 2007 November; 25(11):1298-306) may be a viable strategy for circumventing HIV infection, whereas deletion of PCSK9 (Cohen et al., Nat Genet. 2005 February; 37(2):161-5) orangiopoietin (Musunuru et al., N Engl J Med. 2010 Dec. 2; 363(23):2220-7) may provide therapeutic effects against statin-resistant hypercholesterolemia or hyperlipidemia. Although these targets may be also addressed using siRNA-mediated protein knockdown, a unique advantage of NHEJ-mediated gene inactivation is the ability to achieve permanent therapeutic benefit without the need for continuing treatment. As with all gene therapies, it will of course be important to establish that each proposed therapeutic use has a favorable benefit-risk ratio.

Hydrodynamic delivery of plasmid DNA encoding Cas9 nd guide RNA along with a repair template into the liver of an adult mouse model of tyrosinemia was shown to be able to correct the mutant Fah gene and rescue expression of the wild-type Fah protein in ~1 out of 250 cells (Nat Biotechnol. 2014 June; 32(6):551-3). In addition, clinical trials successfully used ZF nucleases to combat HIV infection by ex vivo knockout of the CCR5 receptor. In all patients, HIV DNA levels decreased, and in one out of four patients, HIV RNA became undetectable (Tebas et al., N Engl J Med. 2014 Mar. 6; 370(10):901-10). Both of these results demonstrate the promise of programmable nucleases as a new therapeutic platform.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the CRISPR-Cas system of the present invention. A minimum of $2.5 \times 10^6$ CD34+ cells per kilogram patient weight may be collected and prestimulated for 16 to 20 hours in X-VIVO 15 medium (Lonza) containing 2 µmol/L-glutamine, stem cell factor (100 ng/ml), Flt-3 ligand (Flt-3L) (100 ng/ml), and thrombopoietin (10 ng/ml) (CellGenix) at a density of $2 \times 10^6$ cells/ml. Prestimulated cells may be transduced with lentiviral at a multiplicity of infection of 5 for 16 to 24 hours in 75-cm$^2$ tissue culture flasks coated with fibronectin (25 mg/cm$^2$) (RetroNectin, Takara Bio Inc.).

With the knowledge in the art and the teachings in this disclosure the skilled person can correct HSCs as to immunodeficiency condition such as HIV/AIDS comprising contacting an HSC with a CRISPR-Cas9 system that targets and knocks out CCR5. An guide RNA (and advantageously a dual guide approach, e.g., a pair of different guide RNAs; for instance, guide RNAs targeting of two clinically relevant genes, B2M and CCR5, in primary human CD4+ T cells and CD34+ hematopoietic stem and progenitor cells (HSPCs)) that targets and knocks out CCR5-and-Cpf1 protein containing particle is contacted with HSCs. The so contacted cells can be administered; and optionally treated/expanded; cf. Cartier. See also Kiem, "Hematopoietic stem cell-based gene therapy for HIV disease," Cell Stem Cell. Feb. 3, 2012; 10(2): 137-147; incorporated herein by reference along with the documents it cites; Mandal et al, "Efficient Ablation of Genes in Human Hematopoietic Stem and Effector Cells using CRISPR/Cas9," Cell Stem Cell, Volume 15, Issue 5, p643-652, 6 Nov. 2014; incorporated herein by reference along with the documents it cites. Mention is also made of Ebina, "CRISPR/Cas9 system to suppress HIV-1 expression by editing HIV-1 integrated proviral DNA" SCIENTIFIC REPORTS |3:2510|DOI: 10.1038/srep02510, incorporated herein by reference along with the documents it cites, as another means for combatting HIV/AIDS using a CRISPR-Cpf1 system.

The rationale for genome editing for HIV treatment originates from the observation that individuals homozygous for loss of function mutations in CCR5, a cellular co-receptor for the virus, are highly resistant to infection and otherwise healthy, suggesting that mimicking this mutation with genome editing could be a safe and effective therapeutic strategy [Liu, R., et al. Cell 86, 367-377 (1996)]. This idea was clinically validated when an HIV infected patient was given an allogeneic bone marrow transplant from a donor homozygous for a loss of function CCR5 mutation, resulting in undetectable levels of HIV and restoration of normal CD4 T-cell counts [Hutter, G., et al. The New England journal of medicine 360, 692-698 (2009)]. Although bone marrow transplantation is not a realistic treatment strategy for most HIV patients, due to cost and potential graft vs. host disease, HIV therapies that convert a patient's own T-cells into CCR5 are desirable.

Early studies using ZFNs and NHEJ to knockout CCR5 in humanized mouse models of HIV showed that transplantation of CCR5 edited CD4 T cells improved viral load and CD4 T-cell counts [Perez, E. E., et al. Nature biotechnology 26, 808-816 (2008)]. Importantly, these models also showed that HIV infection resulted in selection for CCR5 null cells, suggesting that editing confers a fitness advantage and potentially allowing a small number of edited cells to create a therapeutic effect.

As a result of this and other promising preclinical studies, genome editing therapy that knocks out CCR5 in patient T cells has now been tested in humans [Holt, N., et al. Nature biotechnology 28, 839-847 (2010); Li, L., et al. Molecular therapy: the journal of the American Society of Gene Therapy 21, 1259-1269 (2013)]. In a recent phase I clinical trial, CD4+ T cells from patients with HIV were removed, edited with ZFNs designed to knockout the CCR5 gene, and autologously transplanted back into patients [Tebas, P., et al. The New England journal of medicine 370, 901-910 (2014)].

In another study (Mandal et al., Cell Stem Cell, Volume 15, Issue 5, p643-652, 6 Nov. 2014), CRISPR-Cas9 has targeted two clinical relevant genes, B2M and CCR5, in human CD4+ T cells and CD34+ hematopoietic stem and progenitor cells (HSPCs). Use of single RNA guides led to highly efficient mutagenesis in HSPCs but not in T cells. A dual guide approach improved gene deletion efficacy in both cell types. HSPCs that had undergone genome editing with CRISPR-Cas9 retained multilineage potential. Predicted on- and off-target mutations were examined via target capture sequencing in HSPCs and low levels of off-target mutagenesis were observed at only one site. These results demonstrate that CRISPR-Cas9 can efficiently ablate genes in HSPCs with minimal off-target mutagenesis, which have broad applicability for hematopoietic cell-based therapy.

Wang et al. (PLoS One. 2014 Dec. 26; 9(12):e115987. doi: 10.1371/journal.pone.0115987) silenced CCR5 via CRISPR associated protein 9 (Cas9) and single guided RNAs (guide RNAs) with lentiviral vectors expressing Cas9 and CCR5 guide RNAs. Wang et al. showed that a single round transduction of lentiviral vectors expressing Cas9 and CCR5 guide RNAs into HIV-1 susceptible human CD4+ cells yields high frequencies of CCR5 gene disruption. CCR5 gene-disrupted cells are not only resistant to R5-tropic HIV-1, including transmitted/founder (T/F) HIV-1 isolates, but also have selective advantage over CCR5 gene-undisrupted cells during R5-tropic HIV-1 infection. Genome mutations at potential off-target sites that are highly homologous to these CCR5 guide RNAs in stably transduced cells even at 84 days post transduction were not detected by a T7 endonuclease I assay.

Fine et al. (Sci Rep. 2015 Jul. 1; 5:10777. doi: 10.1038/srep10777) identified a two-cassette system expressing pieces of the *S. pyogenes* Cas9 (SpCas9) protein which splice together in cellula to form a functional protein capable of site-specific DNA cleavage. With specific CRISPR guide strands, Fine et al. demonstrated the efficacy of this system in cleaving the HBB and CCR5 genes in human HEK-293T cells as a single Cas9 and as a pair of Cas9 nickases. The trans-spliced SpCas9 (tsSpCas9) displayed ~35% of the nuclease activity compared with the wild-type SpCas9 (wtSpCas9) at standard transfection doses, but had substantially decreased activity at lower dosing levels. The greatly reduced open reading frame length of the tsSpCas9 relative to wtSpCas9 potentially allows for more complex and longer genetic elements to be packaged into an AAV vector including tissue-specific promoters, multiplexed guide RNA expression, and effector domain fusions to SpCas9.

Li et al. (J Gen Virol. 2015 August; 96(8):2381-93. doi: 10.1099/vir.0.000139. Epub 2015 Apr. 8) demonstrated that CRISPR-Cas9 can efficiently mediate the editing of the CCR5 locus in cell lines, resulting in the knockout of CCR5 expression on the cell surface. Next-generation sequencing revealed that various mutations were introduced around the predicted cleavage site of CCR5. For each of the three most effective guide RNAs that were analyzed, no significant off-target effects were detected at the 15 top-scoring potential sites. By constructing chimeric Ad5F35 adenoviruses carrying CRISPR-Cas9 components, Li et al. efficiently transduced primary CD4+ T-lymphocytes and disrupted CCR5 expression, and the positively transduced cells were conferred with HIV-1 resistance.

One of skill in the art may utilize the above studies of, for example, Holt, N., et al. Nature biotechnology 28, 839-847 (2010), Li, L., et al. Molecular therapy: the journal of the American Society of Gene Therapy 21, 1259-1269 (2013), Mandal et al., Cell Stem Cell, Volume 15, Issue 5, p643-652, 6 Nov. 2014, Wang et al. (PLoS One. 2014 Dec. 26; 9(12):e115987. doi: 10.1371/journal.pone.0115987), Fine et al. (Sci Rep. 2015 Jul. 1; 5:10777. doi: 10.1038/srep10777) and Li et al. (J Gen Virol. 2015 August; 96(8):2381-93. doi: 10.1099/vir.0.000139. Epub 2015 Apr. 8) for targeting CCR5 with the CRISPR Cas system of the present invention.

Treating Pathogens, Like Viral Pathogens, Such as HBV

The present invention may also be applied to treat hepatitis B virus (HBV). However, the CRISPR Cas system must be adapted to avoid the shortcomings of RNAi, such as the risk of oversatring endogenous small RNA pathways, by for example, optimizing dose and sequence (see, e.g., Grimm et al., Nature vol. 441, 26 May 2006). For example, low doses, such as about $1-10 \times 10^{14}$ particles per human are contemplated. In another embodiment, the CRISPR Cas system directed against HBV may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of CRISPR Cas targeted to HBV RNA in a SNALP are contemplated. The daily treatment may be over about three days and then weekly for about five weeks. In another embodiment, the system of Chen et al. (Gene Therapy (2007) 14, 11-19) may be used/and or adapted for the CRISPR Cas system of the present invention. Chen et al. use a double-stranded adenoassociated virus 8-pseudotyped vector (dsAAV2/8) to deliver shRNA. A single administration of dsAAV2/8 vector ($1 \times 10^{12}$ vector genomes per mouse), carrying HBV-specific shRNA, effectively suppressed the steady level of HBV protein, mRNA and replicative DNA in liver of HBV transgenic mice, leading to up to 2-3 $\log_{10}$ decrease in HBV load in the circulation. Significant HBV suppression sustained for at least 120 days after vector administration. The therapeutic effect of shRNA was target sequence dependent and did not involve activation of interferon. For the present invention, a CRISPR Cas system directed to HBV may be cloned into an AAV vector, such as a dsAAV2/8 vector and administered to a human, for example, at a dosage of about $1 \times 10^{15}$ vector genomes to about $1 \times 10^{16}$ vector genomes per human. In another embodiment, the method of Wooddell et al. (Molecular Therapy vol. 21 no. 5, 973-985 May 2013) may be used/and or adapted to the CRISPR Cas system of the present invention. Wooddell et al. show that simple coinjection of a hepatocyte-targeted, N-acetylgalactosamine-conjugated melittin-like peptide (NAG-MLP) with a liver-tropic cholesterol-conjugated siRNA (chol-siRNA) targeting coagulation factor VII (F7) results in efficient F7 knockdown in mice and nonhuman primates without changes in clinical chemistry or induction of cytokines. Using transient and transgenic mouse models of HBV infection, Wooddell et al. show that a single coinjection of NAG-MLP with potent chol-siRNAs targeting conserved HBV sequences resulted in multilog repression of viral RNA, proteins, and viral DNA with long duration of effect. Intraveinous coinjections, for example, of about 6 mg/kg of NAG-MLP and 6 mg/kg of HBV specific CRISPR Cas may be envisioned for the present invention. In the alternative, about 3 mg/kg of NAG-MLP and 3 mg/kg of HBV specific CRISPR Cas may be delivered on day one, followed by administration of about 2-3 mg/kg of NAG-MLP and 2-3 mg/kg of HBV specific CRISPR Cas two weeks later.

Lin et al. (Mol Ther Nucleic Acids. 2014 Aug. 19; 3:e186. doi: 10.1038/mtna.2014.38) designed eight gRNAs against HBV of genotype A. With the HBV-specific gRNAs, the CRISPR-Cas9 system significantly reduced the production of HBV core and surface proteins in Huh-7 cells transfected with an HBV-expression vector. Among eight screened gRNAs, two effective ones were identified. One gRNA targeting the conserved HBV sequence acted against different genotypes. Using a hydrodynamics-HBV persistence mouse model, Lin et al. further demonstrated that this system could cleave the intrahepatic HBV genome-containing plasmid and facilitate its clearance in vivo, resulting in reduction of serum surface antigen levels. These data suggest that the CRISPR-Cas9 system could disrupt the HBV-expressing templates both in vitro and in vivo, indicating its potential in eradicating persistent HBV infection.

Dong et al. (Antiviral Res. 2015 June; 118:110-7. doi: 10.1016/j.antiviral.2015.03.015. Epub 2015 Apr. 3) used the CRISPR-Cas9 system to target the HBV genome and efficiently inhibit HBV infection. Dong et al. synthesized four single-guide RNAs (guide RNAs) targeting the conserved regions of HBV. The expression of these guide RNAS with Cas9 reduced the viral production in Huh7 cells as well as in HBV-replication cell HepG2.2.15. Dong et al. further demonstrated that CRISPR-Cas9 direct cleavage and cleavage-mediated mutagenesis occurred in HBV cccDNA of transfected cells. In the mouse model carrying HBV cccDNA, injection of guide RNA-Cas9 plasmids via rapid tail vein resulted in the low level of cccDNA and HBV protein.

Liu et al. (J Gen Virol. 2015 August; 96(8):2252-61. doi: 10.1099/vir.0.000159. Epub 2015 Apr. 22) designed eight guide RNAs (gRNAs) that targeted the conserved regions of different HBV genotypes, which could significantly inhibit HBV replication both in vitro and in vivo to investigate the possibility of using the CRISPR-Cas9 system to disrupt the HBV DNA templates. The HBV-specific gRNA/Cpf1 system could inhibit the replication of HBV of different genotypes in cells, and the viral DNA was significantly reduced by a single gRNA/Cpf1 system and cleared by a combination of different gRNA/Cpf1 systems.

Wang et al. (World J Gastroenterol. 2015 Aug. 28; 21(32): 9554-65. doi: 10.3748/wjg.v21.i32.9554) designed 15 gRNAs against HBV of genotypes A-D. Eleven combinations of two above gRNAs (dual-gRNAs) covering the regulatory region of HBV were chosen. The efficiency of each gRNA and 11 dual-gRNAs on the suppression of HBV (genotypes A-D) replication was examined by the measurement of HBV surface antigen (HBsAg) or e antigen (HBeAg) in the culture supernatant. The destruction of HBV-expressing vector was examined in HuH7 cells co-transfected with dual-gRNAs and HBV-expressing vector using polymerase chain reaction (PCR) and sequencing method, and the destruction of cccDNA was examined in HepAD38 cells using KCl precipitation, plasmid-safe ATP-dependent DNase (PSAD) digestion, rolling circle amplification and quantitative PCR combined method. The cytotoxicity of these gRNAs was assessed by a mitochondrial tetrazolium assay. All of gRNAs could significantly reduce HBsAg or HBeAg production in the culture supernatant, which was dependent on the region in which gRNA against. All of dual gRNAs could efficiently suppress HBsAg and/or HBeAg production for HBV of genotypes A-D, and the efficacy of dual gRNAs in suppressing HBsAg and/or HBeAg production was significantly increased when compared to the single gRNA used alone. Furthermore, by PCR direct sequencing we confirmed that these dual gRNAs could specifically destroy HBV expressing template by removing the fragment between the cleavage sites of the two used gRNAs. Most importantly, gRNA-5 and gRNA-12 combination not only could efficiently suppressing HBsAg and/or HBeAg production, but also destroy the cccDNA reservoirs in HepAD38 cells.

Karimova et al. (Sci Rep. 2015 Sep. 3; 5:13734. doi: 10.1038/srep13734) identified cross-genotype conserved HBV sequences in the S and X region of the HBV genome that were targeted for specific and effective cleavage by a Cas9 nickase. This approach disrupted not only episomal cccDNA and chromosomally integrated HBV target sites in reporter cell lines, but also HBV replication in chronically and de novo infected hepatoma cell lines.

One of skill in the art may utilize the above studies of, for example, Lin et al. (Mol Ther Nucleic Acids. 2014 Aug. 19; 3:e186. doi: 10.1038/mtna.2014.38), Dong et al. (Antiviral Res. 2015 June; 118:110-7. doi: 10.1016/j.antiviral.2015.03.015. Epub 2015 Apr. 3), Liu et al. (J Gen Virol. 2015 August; 96(8):2252-61. doi: 10.1099/vir.0.000159. Epub 2015 Apr. 22), Wang et al. (World J Gastroenterol. 2015 Aug. 28; 21(32):9554-65. doi: 10.3748/wjg.v21.i32.9554) and Karimova et al. (Sci Rep. 2015 Sep. 3; 5:13734. doi: 10.1038/srep13734) for targeting HBV with the CRISPR Cas system of the present invention.

Chronic hepatitis B virus (HBV) infection is prevalent, deadly, and seldom cured due to the persistence of viral episomal DNA (cccDNA) in infected cells. Ramanan et al. (Ramanan V, Shlomai A, Cox D B, Schwartz R E, Michailidis E, Bhatta A, Scott D A, Zhang F, Rice C M, Bhatia S N, Sci Rep. 2015 Jun. 2; 5:10833. doi: 10.1038/srep10833, published online 2 Jun. 2015.) showed that the CRISPR/Cas9 system can specifically target and cleave conserved regions in the HBV genome, resulting in robust suppression of viral gene expression and replication. Upon sustained expression of Cas9 and appropriately chosen guide RNAs, they demonstrated cleavage of cccDNA by Cas9 and a dramatic reduction in both cccDNA and other parameters of viral gene expression and replication. Thus, they showed that directly targeting viral episomal DNA is a novel therapeutic approach to control the virus and possibly cure patients. This is also described in WO2015089465 A1, in the name of The Broad Institute et al., the contents of which are hereby incorporated by reference As such targeting viral episomal DNA in HBV is preferred in some embodiments.

The present invention may also be applied to treat pathogens, e.g. bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria.

The present invention may also be applied to treat hepatitis C virus (HCV). The methods of Roelvinki et al. (Molecular Therapy vol. 20 no. 9, 1737-1749 September 2012) may be applied to the CRISPR Cas system. For example, an AAV vector such as AAV8 may be a contemplated vector and for example a dosage of about 1.25×1011 to 1.25×1013 vector genomes per kilogram body weight (vg/kg) may be contemplated. The present invention may also be applied to treat pathogens, e.g. bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria.

Jiang et al. ("RNA-guided editing of bacterial genomes using CRISPR-Cas systems," Nature Biotechnology vol. 31, p. 233-9, March 2013) used a CRISPR-Cas9 system to mutate or kill *S. pneumoniae* and *E. coli*. The work, which introduced precise mutations into the genomes, relied on dual-RNA:Cas9-directed cleavage at the targeted genomic site to kill unmutated cells and circumvented the need for selectable markers or counter-selection systems. CRISPR systems have be used to reverse antibiotic resistance and eliminate the transfer of resistance between strains. Bickard et al. showed that Cas9, reprogrammed to target virulence genes, kills virulent, but not avirulent, *S. aureus*. Reprogramming the nuclease to target antibiotic resistance genes destroyed staphylococcal plasmids that harbor antibiotic resistance genesand immunized against the spread of plasmid-borne resistance genes. (see, Bikard et al., "Exploiting CRISPR-Cas nucleases to produce sequence-specific antimicrobials," Nature Biotechnology vol. 32, 1146-1150, doi: 10.1038/nbt.3043, published online 5 Oct. 2014.) Bikard showed that CRISPR-Cas9 antimicrobials function in vivo to kill *S. aureus* in a mouse skin colonization model.

Similarly, Yosef et al used a CRISPR system to target genes encoding enzymes that confer resistance to β-lactam antibiotics (see Yousef et al., "Temperate and lytic bacteriophages programmed to sensitize and kill antibiotic-resistant bacteria," Proc. Natl. Acad. Sci. USA, vol. 112, p. 7267-7272, doi: 10.1073/pnas.1500107112 published online May 18, 2015).

CRISPR systems can be used to edit genomes of parasites that are resistant to other genetic approaches. For example, a CRISPR-Cas9 system was shown to introduce double-stranded breaks into the in the *Plasmodium yoelii* genome (see, Zhang et al., "Efficient Editing of Malaria Parasite Genome Using the CRISPR/Cas9 System," mBio. vol. 5, e01414-14, July-August 2014). Ghorbal et al. ("Genome editing in the human malaria parasite *Plasmodium* falciparum-using the CRISPR-Cas9 system," Nature Biotechnology, vol. 32, p. 819-821, doi: 10.1038/nbt.2925, published online Jun. 1, 2014) modified the sequences of two genes, orc1 and kelch13, which have putative roles in gene silencing and emerging resistance to artemisinin, respectively. Parasites that were altered at the appropriate sites were recovered with very high efficiency, despite there being no direct selection for the modification, indicating that neutral or even deleterious mutations can be generated using this system. CRISPR-Cas9 is also used to modify the genomes of other pathogenic parasites, including *Toxoplasma gondii* (see Shen et al., "Efficient gene disruption in diverse strains of *Toxoplasma gondii* using CRISPR/CAS9," mBio vol. 5:e01114-14, 2014; and Sidik et al., "Efficient Genome Engineering of *Toxoplasma gondii* Using CRISPR/Cas9," PLoS One vol. 9, e100450, doi: 10.1371/journal.pone.0100450, published online Jun. 27, 2014).

Vyas et al. ("A *Candida albicans* CRISPR system permits genetic engineering of essential genes and gene families," Science Advances, vol. 1, e1500248, DOI: 10.1 126/sciadv.1500248, Apr. 3, 2015) employed a CRISPR system to overcome long-standing obstacles to genetic engineering in *C. albicans* and efficiently mutate in a single experiment both copies of several different genes. In an organism where several mechanisms contribute to drug resistance, Vyas produced homozygous double mutants that no longer displayed the hyper-resistance to fluconazole or cycloheximide displayed by the parental clinical isolate Can90. Vyas also obtained homozygous loss-of-function mutations in essential genes of *C. albicans* by creating conditional alleles. Null alleles of DCR1, which is required for ribosomal RNA processing, are lethal at low temperature but viable at high temperature. Vyas used a repair template that introduced a nonsense mutation and isolated dcr1/dcr1 mutants that failed to grow at 16° C.

Treating Diseases with Genetic or Epigenetic Aspects

The CRISPR-Cas systems of the present invention can be used to correct genetic mutations that were previously attempted with limited success using TALEN and ZFN and have been identified as potential targets for Cas9 systems, including as in published applications of Editas Medicine describing methods to use Cas9 systems to target loci to therapeutically address diseases with gene therapy, including, WO 2015/048577 CRISPR-RELATED METHODS AND COMPOSITIONS of Gluckmann et al.; WO 2015/070083 CRISPR-RELATED METHODS AND COMPOSITIONS WITH GOVERNING gRNAS of Glucksmann et al. In some embodiments, the treatment, prophylaxis or diagnosis of Primary Open Angle Glaucoma (POAG) is provided. The target is preferably the MYOC gene. This is described in WO2015153780, the disclosure of which is hereby incorporated by reference.

Mention is made of WO2015/134812 CRISPR/CAS-RELATED METHODS AND COMPOSITIONS FOR TREATING USHER SYNDROME AND RETINITIS PIGMENTOSA of Maeder et al. Through the teachings herein the invention comprehends methods and materials of these documents applied in conjunction with the teachings herein. In an aspect of ocular and auditory gene therapy, methods and compositions for treating Usher Syndrome and Retinis-Pigmentosa may be adapted to the CRISPR-Cas system of the present invention (see, e.g., WO 2015/134812). In an embodiment, the WO 2015/134812 involves a treatment or delaying the onset or progression of Usher Syndrome type IIA (USH2A, USH11A) and retinitis pigmentosa 39 (RP39) by gene editing, e.g., using CRISPR-Cas9 mediated methods to correct the guanine deletion at position 2299 in the USH2A gene (e.g., replace the deleted guanine residue at position 2299 in the USH2A gene). A similar effect can be achieved with Cpf1. In a related aspect, a mutation is targeted by cleaving with either one or more nuclease, one or more nickase, or a combination thereof, e.g., to induce HDR with a donor template that corrects the point mutation (e.g., the single nucleotide, e.g., guanine, deletion). The alteration or correction of the mutant USH2A gene can be mediated by any mechanism. Exemplary mechanisms that can be associated with the alteration (e.g., correction) of the mutant HSH2A gene include, but are not limited to, non-homologous end joining, microhomology-mediated end joining (MMEJ), homology-directed repair (e.g., endogenous donor template mediated), SDSA (synthesis dependent strand annealing), single-strand annealing or single strand invasion. In an embodiment, the method used for treating Usher Syndrome and Retinis-Pigmentosa can include acquiring knowledge of the mutation carried by the subject, e.g., by sequencing the appropriate portion of the USH2A gene.

Mention is also made of WO 2015/138510 and through the teachings herein the invention (using a CRISPR-Cas9 system) comprehends providing a treatment or delaying the onset or progression of Leber's Congenital Amaurosis 10 (LCA 10). LCA 10 is caused by a mutation in the CEP290 gene, e.g., a c.2991+1655, adenine to guanine mutation in the CEP290 gene which gives rise to a cryptic splice site in intron 26. This is a mutation at nucleotide 1655 of intron 26 of CEP290, e.g., an A to G mutation. CEP290 is also known as: CT87; MKS4; POC3; rd16; BBS14; JBTS5; LCAJO; NPHP6; SLSN6; and 3H11Ag (see, e.g., WO 2015/138510). In an aspect of gene therapy, the invention involves introducing one or more breaks near the site of the LCA target position (e.g., c.2991+1655; A to G) in at least one allele of the CEP290 gene. Altering the LCA10 target position refers to (1) break-induced introduction of an indel (also referred to herein as NHEJ-mediated introduction of an indel) in close proximity to or including a LCA10 target position (e.g., c.2991+1655A to G), or (2) break-induced deletion (also referred to herein as NHEJ-mediated deletion) of genomic sequence including the mutation at a LCA10 target position (e.g., c.2991+1655A to G). Both approaches give rise to the loss or destruction of the cryptic splice site resulting from the mutation at the LCA 10 target position.

Researchers are contemplating whether gene therapies could be employed to treat a wide range of diseases. The CRISPR systems of the present invention based on Cpf1 effector protein are envisioned for such therapeutic uses, including, but noted limited to further exemplified targeted areas and with delivery methods as below. Some examples of conditions or diseases that might be usefully treated using the present system are included in the examples of genes and references included herein and are currently associated with those conditions are also provided there. The genes and conditions exemplified are not exhaustive.

Treating Diseases of the Circulatory System

The present invention also contemplates delivering the CRISPR-Cas system, specifically the novel CRISPR effector protein systems described herein, to the blood or hematopoetic stem cells. The plasma exosomes of Wahlgren et al. (Nucleic Acids Research, 2012, Vol. 40, No. 17 e130) were previously described and may be utilized to deliver the CRISPR Cas system to the blood. The nucleic acid-targeting system of the present invention is also contemplated to treat hemoglobinopathies, such as thalassemias and sickle cell disease. See, e.g., International Patent Publication No. WO 2013/126794 for potential targets that may be targeted by the CRISPR Cas system of the present invention.

Drakopoulou, "Review Article, The Ongoing Challenge of Hematopoietic Stem Cell-Based Gene Therapy for β-Thalassemia," Stem Cells International, Volume 2011, Article ID 987980, 10 pages, doi:10.4061/2011/987980, incorporated herein by reference along with the documents it cites, as if set out in full, discuss modifying HSCs using a lentivirus that delivers a gene for β-globin or γ-globin. In contrast to using lentivirus, with the knowledge in the art and the teachings in this disclosure, the skilled person can correct HSCs as to p3-Thalassemia using a CRISPR-Cas system that targets and corrects the mutation (e.g., with a suitable HDR template that delivers a coding sequence for β-globin or γ-globin, advantageously non-sickling β-globin or γ-globin); specifically, the guide RNA can target mutation that give rise to β-Thalassemia, and the HDR can provide coding for proper expression of β-globin or γ-globin. An guide RNA that targets the mutation-and-Cas protein containing particle is contacted with HSCs carrying the mutation. The particle also can contain a suitable HDR template to correct the mutation for proper expression of β-globin or γ-globin; or the HSC can be contacted with a second particle or a vector that contains or delivers the HDR template. The so contacted cells can be administered; and optionally treated/expanded; cf. Cartier. In this regard mention is made of: Cavazzana, "Outcomes of Gene Therapy for β-Thalassemia Major via Transplantation of Autologous Hematopoietic Stem Cells Transduced Ex Vivo with a Lentiviral $β^{A-T87Q}$-Globin Vector." tif2014.org/abstractFiles/Jean%20Antoine%20Ribeil_Abstract.pdf; Cavazzana-Calvo, "Transfusion independence and HMGA2 activation after gene therapy of human β-thalassaemia", Nature 467, 318-322 (16 Sep. 2010) doi:10.1038/nature09328; Nienhuis, "Development of Gene Therapy for Thalassemia, Cold Spring Harbor Perpsectives in Medicine, doi: 10.1101/cshperspect.a011833 (2012), LentiGlobin BB305, a lentiviral vector containing an engineered β-globin gene (βA-T87Q); and Xie et al., "Seamless gene correction of β-thalassaemia mutations in patient-specific iPSCs using CRISPR/Cas9 and piggyback" Genome Research gr.173427.114 (2014) worldwideweb.genome.org/cgi/doi/10.1101/gr.173427.114 (Cold Spring Harbor Laboratory Press); that is the subject of Cavazzana work involving human β-thalassaemia and the subject of the Xie work, are all incorporated herein by reference, together with all documents cited therein or associated therewith. In the instant invention, the HDR template can provide for the HSC to express an engineered β-globin gene (e.g., PA-T87Q), or β-globin as in Xie.

Xu et al. (Sci Rep. 2015 Jul. 9; 5:12065. doi: 10.1038/srep12065) have designed TALENs and CRISPR-Cas9 to directly target the intron2 mutation site IVS2-654 in the globin gene. Xu et al. observed different frequencies of double-strand breaks (DSBs) at IVS2-654 loci using TALENs and CRISPR-Cas9, and TALENs mediated a higher homologous gene targeting efficiency compared to CRISPR-Cas9 when combined with the piggyBac transposon donor. In addition, more obvious off-target events were observed for CRISPR-Cas9 compared to TALENs. Finally, TALENs-corrected iPSC clones were selected for erythroblast differentiation using the OP9 co-culture system and detected relatively higher transcription of HBB than the uncorrected cells. Song et al. (Stem Cells Dev. 2015 May 1; 24(9):1053-65. doi: 10.1089/scd.2014.0347. Epub 2015 February 5) used CRISPR/Cas9 to correct β-Tha1 iPSCs; gene-corrected cells exhibit normal karyotypes and full pluripotency as human embryonic stem cells (hESCs) showed no off-targeting effects. Then, Song et al. evaluated the differentiation efficiency of the gene-corrected β-Tha1 iPSCs. Song et al. found that during hematopoietic differentiation, gene-corrected β-Tha1 iPSCs showed an increased embryoid body ratio and various hematopoietic progenitor cell percentages. More importantly, the gene-corrected β-Tha1 iPSC lines restored HBB expression and reduced reactive oxygen species production compared with the uncorrected group. Song et al.'s study suggested that hematopoietic differentiation efficiency of β-Tha1 iPSCs was greatly improved once corrected by the CRISPR-Cas9 system. Similar methods may be performed utilizing the CRISPR-Cas systems described herein, e.g. systems comprising Cpf1 effector proteins.

Sickle cell anemia is an autosomal recessive genetic disease in which red blood cells become sickle-shaped. It is caused by a single base substitution in the β-globin gene, which is located on the short arm of chromosome 11. As a result, valine is produced instead of glutamic acid causing the production of sickle hemoglobin (HbS). This results in the formation of a distorted shape of the erythrocytes. Due to this abnormal shape, small blood vessels can be blocked, causing serious damage to the bone, spleen and skin tissues. This may lead to episodes of pain, frequent infections, hand-foot syndrome or even multiple organ failure. The distorted erythrocytes are also more susceptible to hemolysis, which leads to serious anemia. As in the case of β-thalassaemia, sickle cell anemia can be corrected by modifying HSCs with the CRISPR-Cas system. The system allows the specific editing of the cell's genome by cutting its DNA and then letting it repair itself. The Cas protein is inserted and directed by a RNA guide to the mutated point and then it cuts the DNA at that point. Simultaneously, a healthy version of the sequence is inserted. This sequence is used by the cell's own repair system to fix the induced cut. In this way, the CRISPR-Cas allows the correction of the mutation in the previously obtained stem cells. With the knowledge in the art and the teachings in this disclosure, the skilled person can correct HSCs as to sickle cell anemia using a CRISPR-Cas system that targets and corrects the mutation (e.g., with a suitable HDR template that delivers a coding sequence for β-globin, advantageously non-sickling β-globin); specifically, the guide RNA can target mutation that give rise to sickle cell anemia, and the HDR can provide coding for proper expression of β-globin. An guide RNA that targets the mutation-and-Cas protein containing particle is contacted with HSCs carrying the mutation. The particle also can contain a suitable HDR template to correct the mutation for proper expression of β-globin; or the HSC can be contacted with a second particle or a vector that contains or delivers the HDR template. The so contacted cells can be administered; and optionally treated/expanded; cf. Cartier.

The HDR template can provide for the HSC to express an engineered β-globin gene (e.g., βA-T87Q), or β-globin as in Xie.

Williams, "Broadening the Indications for Hematopoietic Stem Cell Genetic Therapies," Cell Stem Cell 13:263-264 (2013), incorporated herein by reference along with the documents it cites, as if set out in full, report lentivirus-mediated gene transfer into HSC/P cells from patients with the lysosomal storage disease metachromatic leukodystrophy disease (MLD), a genetic disease caused by deficiency of arylsulfatase A (ARSA), resulting in nerve demyelination; and lentivirus-mediated gene transfer into HSCs of patients with Wiskott-Aldrich syndrome (WAS) (patients with defective WAS protein, an effector of the small GTPase CDC42 that regulates cytoskeletal function in blood cell lineages and thus suffer from immune deficiency with recurrent infections, autoimmune symptoms, and thrombocytopenia with abnormally small and dysfunctional platelets leading to excessive bleeding and an increased risk of leukemia and lymphoma). In contrast to using lentivirus, with the knowledge in the art and the teachings in this disclosure, the skilled person can correct HSCs as to MLD (deficiency of arylsulfatase A (ARSA)) using a CRISPR-Cas system that targets and corrects the mutation (deficiency of arylsulfatase A (ARSA)) (e.g., with a suitable HDR template that delivers a coding sequence for ARSA); specifically, the guide RNA can target mutation that gives rise to MLD (deficient ARSA), and the HDR can provide coding for proper expression of ARSA. An guide RNA that targets the mutation-and-Cas protein containing particle is contacted with HSCs carrying the mutation. The particle also can contain a suitable HDR template to correct the mutation for proper expression of ARSA; or the HSC can be contacted with a second particle or a vector that contains or delivers the HDR template. The so contacted cells can be administered; and optionally treated/expanded; cf. Cartier. In contrast to using lentivirus, with the knowledge in the art and the teachings in this disclosure, the skilled person can correct HSCs as to WAS using a CRISPR-Cas system that targets and corrects the mutation (deficiency of WAS protein) (e.g., with a suitable HDR template that delivers a coding sequence for WAS protein); specifically, the guide RNA can target mutation that gives rise to WAS (deficient WAS protein), and the HDR can provide coding for proper expression of WAS protein. An guide RNA that targets the mutation-and-Cpf1 protein containing particle is contacted with HSCs carrying the mutation. The particle also can contain a suitable HDR template to correct the mutation for proper expression of WAS protein; or the HSC can be contacted with a second particle or a vector that contains or delivers the HDR template. The so contacted cells can be administered; and optionally treated/expanded; cf. Cartier.

Watts, "Hematopoietic Stem Cell Expansion and Gene Therapy" Cytotherapy 13(10):1164-1171. doi:10.3109/14653249.2011.620748 (2011), incorporated herein by reference along with the documents it cites, as if set out in full, discusses hematopoietic stem cell (HSC) gene therapy, e.g., virus-mediated HSC gene thereapy, as an highly attractive treatment option for many disorders including hematologic conditions, immunodeficiencies including HIV/AIDS, and other genetic disorders like lysosomal storage diseases, including SCID-X1, ADA-SCID, β-thalassemia, X-linked CGD, Wiskott-Aldrich syndrome, Fanconi anemia, adreno-leukodystrophy (ALD), and metachromatic leukodystrophy (MLD).

US Patent Publication Nos. 20110225664, 20110091441, 20100229252, 20090271881 and 20090222937 assigned to Cellectis, relates to CREI variants, wherein at least one of the two I-CreI monomers has at least two substitutions, one in each of the two functional subdomains of the LAGLI-DADG (SEQ ID NO: 26) core domain situated respectively from positions 26 to 40 and 44 to 77 of I-CreI, said variant being able to cleave a DNA target sequence from the human interleukin-2 receptor gamma chain (IL2RG) gene also named common cytokine receptor gamma chain gene or gamma C gene. The target sequences identified in US Patent Publication Nos. 20110225664, 20110091441, 20100229252, 20090271881 and 20090222937 may be utilized for the nucleic acid-targeting system of the present invention.

Severe Combined Immune Deficiency (SCID) results from a defect in lymphocytes T maturation, always associated with a functional defect in lymphocytes B (Cavazzana-Calvo et al., Annu. Rev. Med., 2005, 56, 585-602; Fischer et al., Immunol. Rev., 2005, 203, 98-109). Overall incidence is estimated to 1 in 75 000 births. Patients with untreated SCID are subject to multiple opportunist micro-organism infections, and do generally not live beyond one year. SCID can be treated by allogenic hematopoietic stem cell transfer, from a familial donor. Histocompatibility with the donor can vary widely. In the case of Adenosine Deaminase (ADA) deficiency, one of the SCID forms, patients can be treated by injection of recombinant Adenosine Deaminase enzyme.

Since the ADA gene has been shown to be mutated in SCID patients (Giblett et al., Lancet, 1972, 2, 1067-1069), several other genes involved in SCID have been identified (Cavazzana-Calvo et al., Annu. Rev. Med., 2005, 56, 585-602; Fischer et al., Immunol. Rev., 2005, 203, 98-109). There are four major causes for SCID: (i) the most frequent form of SCID, SCID-X1 (X-linked SCID or X-SCID), is caused by mutation in the IL2RG gene, resulting in the absence of mature T lymphocytes and NK cells. IL2RG encodes the gamma C protein (Noguchi, et al., Cell, 1993, 73, 147-157), a common component of at least five interleukin receptor complexes. These receptors activate several targets through the JAK3 kinase (Macchi et al., Nature, 1995, 377, 65-68), which inactivation results in the same syndrome as gamma C inactivation; (ii) mutation in the ADA gene results in a defect in purine metabolism that is lethal for lymphocyte precursors, which in turn results in the quasi absence of B, T and NK cells; (iii) V(D)J recombination is an essential step in the maturation of immunoglobulins and T lymphocytes receptors (TCRs). Mutations in Recombination Activating Gene 1 and 2 (RAG1 and RAG2) and Artemis, three genes involved in this process, result in the absence of mature T and B lymphocytes; and (iv) Mutations in other genes such as CD45, involved in T cell specific signaling have also been reported, although they represent a minority of cases (Cavazzana-Calvo et al., Annu. Rev. Med., 2005, 56, 585-602; Fischer et al., Immunol. Rev., 2005, 203, 98-109). Since when their genetic bases have been identified, the different SCID forms have become a paradigm for gene therapy approaches (Fischer et al., Immunol. Rev., 2005, 203, 98-109) for two major reasons. First, as in all blood diseases, an ex vivo treatment can be envisioned. Hematopoietic Stem Cells (HSCs) can be recovered from bone marrow, and keep their pluripotent properties for a few cell divisions. Therefore, they can be treated in vitro, and then reinjected into the patient, where they repopulate the bone marrow. Second, since the maturation of lymphocytes is impaired in SCID patients, corrected cells have a selective advantage. Therefore, a small number of corrected cells can restore a functional immune system. This hypothesis was validated several times by (i) the partial restoration of immune functions associated with the reversion of mutations in SCID patients (Hirschhorn et al., Nat. Genet., 1996, 13, 290-295; Stephan et al., N. Engl. J. Med., 1996, 335, 1563-1567; Bousso et al., Proc. Natl., Acad. Sci. USA, 2000, 97, 274-278; Wada et al., Proc. Natl. Acad. Sci. USA, 2001, 98, 8697-8702; Nishikomori et al., Blood, 2004, 103, 4565-4572), (ii) the correction of SCID-X1 deficiencies in vitro in hematopoietic cells (Candotti et al., Blood, 1996, 87, 3097-3102; Cavazzana-Calvo et al., Blood, 1996, Blood, 88, 3901-3909; Taylor et al., Blood, 1996, 87, 3103-3107; Hacein-Bey et al., Blood, 1998, 92, 4090-4097), (iii) the correction of SCID-X1 (Soudais et al., Blood, 2000, 95, 3071-3077; Tsai et al., Blood, 2002, 100, 72-79), JAK-3 (Bunting et al., Nat. Med., 1998, 4, 58-64; Bunting et al., Hum. Gene Ther., 2000, 11, 2353-2364) and RAG2 (Yates et al., Blood, 2002, 100, 3942-3949) deficiencies in vivo in animal models and (iv) by the result of gene therapy clinical trials (Cavazzana-Calvo et al., Science, 2000, 288, 669-672; Aiuti et al., Nat. Med., 2002; 8, 423-425; Gaspar et al., Lancet, 2004, 364, 2181-2187).

US Patent Publication No. 20110182867 assigned to the Children's Medical Center Corporation and the President and Fellows of Harvard College relates to methods and uses of modulating fetal hemoglobin expression (HbF) in a hematopoietic progenitor cells via inhibitors of BCL11A expression or activity, such as RNAi and antibodies. The targets disclosed in US Patent Publication No. 20110182867, such as BCL11A, may be targeted by the CRISPR Cas system of the present invention for modulating fetal hemoglobin expression. See also Bauer et al. (Science 11 Oct. 2013: Vol. 342 no. 6155 pp. 253-257) and Xu et al. (Science 18 Nov. 2011: Vol. 334 no. 6058 pp. 993-996) for additional BCL11A targets.

With the knowledge in the art and the teachings in this disclosure, the skilled person can correct HSCs as to a genetic hematologic disorder, e.g., β-Thalassemia, Hemophilia, or a genetic lysosomal storage disease.

HSC—Delivery to and Editing of Hematopoetic Stem Cells; and Particular Conditions.

The term "Hematopoetic Stem Cell" or "HSC" is meant to include broadly those cells considered to be an HSC, e.g., blood cells that give rise to all the other blood cells and are derived from mesoderm; located in the red bone marrow, which is contained in the core of most bones. HSCs of the invention include cells having a phenotype of hematopoeitic stem cells, identified by small size, lack of lineage (lin) markers, and markers that belong to the cluster of differentiation series, like: CD34, CD38, CD90, CD133, CD105, CD45, and also c-kit, —the receptor for stem cell factor. Hematopoietic stem cells are negative for the markers that are used for detection of lineage commitment, and are, thus, called Lin–; and, during their purification by FACS, a number of up to 14 different mature blood-lineage markers, e.g., CD13 & CD33 for myeloid, CD71 for erythroid, CD19 for B cells, CD61 for megakaryocytic, etc. for humans; and, B220 (murine CD45) for B cells, Mac-1 (CD11b/CD18) for monocytes, Gr-1 for Granulocytes, Ter119 for erythroid cells, I17Ra, CD3, CD4, CD5, CD8 for T cells, etc. Mouse HSC markers: CD34lo/–, SCA-1+, Thy1.1+/lo, CD38+, C-kit+, lin–, and Human HSC markers: CD34+, CD59+, Thy1/CD90+, CD38lo/–, C-kit/CD117+, and lin–. HSCs are identified by markers. Hence in embodiments discussed herein, the HSCs can be CD34+ cells. HSCs can also be hematopoietic stem cells that are CD34–/CD38–. Stem cells that may lack c-kit on the cell surface that are considered in the art as HSCs are within the ambit of the invention, as well as CD133+ cells likewise considered HSCs in the art.

The CRISPR-Cas (eg Cpf1) system may be engineered to target genetic locus or loci in HSCs. Cas (eg Cpf1) protein, advantageously codon-optimized for a eukaryotic cell and especially a mammalian cell, e.g., a human cell, for instance, HSC, and sgRNA targeting a locus or loci in HSC, e.g., the gene EMX1, may be prepared. These may be delivered via particles. The particles may be formed by the Cas (eg Cpf1) protein and the gRNA being admixed. The gRNA and Cas (eg Cpf1) protein mixture may for example be admixed with a mixture comprising or consisting essentially of or consisting of surfactant, phospholipid, biodegradable polymer, lipoprotein and alcohol, whereby particles containing the gRNA and Cas (eg Cpf1) protein may be formed. The invention comprehends so making particles and particles from such a method as well as uses thereof.

More generally, particles may be formed using an efficient process. First, Cas (eg Cpf1) protein and gRNA targeting the gene EMX1 or the control gene LacZ may be mixed together at a suitable, e.g., 3:1 to 1:3 or 2:1 to 1:2 or 1:1 molar ratio, at a suitable temperature, e.g., 15-30 C, e.g., 20-25 C, e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol may be dissolved in an alcohol, advantageously a C1-6 alkyl alcohol, such as methanol, ethanol, isopropanol, e.g., 100% ethanol. The two solutions may be mixed together to form particles containing the Cas (eg Cpf1)-gRNA complexes. In certain embodiments the particle can contain an HDR template. That can be a particle co-administered with gRNA+Cas (eg Cpf1) protein-containing particle, or i.e., in addition to contacting an HSC with an gRNA+Cas (eg Cpf1) protein-containing particle, the HSC is contacted with a particle containing an HDR template; or the HSC is contacted with a particle containing all of the gRNA, Cas (eg Cpf1) and the HDR template. The HDR template can be administered by a separate vector, whereby in a first instance the particle penetrates an HSC cell and the separate vector also penetrates the cell, wherein the HSC genome is modified by the gRNA+Cas (eg Cpf1) and the HDR template is also present, whereby a genomic loci is modified by the HDR; for instance, this may result in correcting a mutation.

After the particles form, HSCs in 96 well plates may be transfected with 15 ug Cas (eg Cpf1) protein per well. Three days after transfection, HSCs may be harvested, and the number of insertions and deletions (indels) at the EMX1 locus may be quantified.

This illustrates how HSCs can be modified using CRISPR-Cas (eg Cpf1) targeting a genomic locus or loci of interest in the HSC. The HSCs that are to be modified can be in vivo, i.e., in an organism, for example a human or a non-human eukaryote, e.g., animal, such as fish, e.g., zebra fish, mammal, e.g., primate, e.g., ape, chimpanzee, macaque, rodent, e.g., mouse, rabbit, rat, canine or dog, livestock (cow/bovine, sheep/ovine, goat or pig), fowl or poultry, e.g., chicken. The HSCs that are to be modified can be in vitro, i.e., outside of such an organism. And, modified HSCs can be used ex vivo, i.e., one or more HSCs of such an organism can be obtained or isolated from the organism, optionally the HSC(s) can be expanded, the HSC(s) are modified by a composition comprising a CRISPR-Cas (eg Cpf1) that targets a genetic locus or loci in the HSC, e.g., by contacting the HSC(s) with the composition, for instance, wherein the composition comprises a particle containing the CRISPR enzyme and one or more gRNA that targets the genetic locus or loci in the HSC, such as a particle obtained or obtainable from admixing an gRNA and Cas (eg Cpf1) protein mixture with a mixture comprising or consisting essentially of or consisting of surfactant, phospholipid, biodegradable polymer, lipoprotein and alcohol (wherein one or more gRNA targets the genetic locus or loci in the HSC), optionally expanding the resultant modified HSCs and administering to the organism the resultant modified HSCs. In some instances the isolated or obtained HSCs can be from a first organism, such as an organism from a same species as a second organism, and the second organism can be the organism to which the resultant modified HSCs are administered, e.g., the first organism can be a donor (such as a relative as in a parent or sibling) to the second organism. Modified HSCs can have genetic modifications to address or alleviate or reduce symptoms of a disease or condition state of an individual or subject or patient. Modified HSCs, e.g., in the instance of a first organism donor to a second organism, can have genetic modifications to have the HSCs have one or more proteins e.g. surface markers or proteins more like that of the second organism. Modified HSCs can have genetic modifications to simulate a disease or condition state of an individual or subject or patient and would be re-administered to a non-human organism so as to prepare an animal model. Expansion of HSCs is within the ambit of the skilled person from this disclosure and knowledge in the art, see e.g., Lee, "Improved ex vivo expansion of adult hematopoietic stem cells by overcoming CUL4-mediated degradation of HOXB4." Blood. 2013 May 16; 121(20):4082-9. doi: 10.1182/blood-2012-09-455204. Epub 2013 March 21.

As indicated to improve activity, gRNA may be pre-complexed with the Cas (eg Cpf1) protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. The invention accordingly comprehends admixing gRNA, Cas (eg Cpf1) protein and components that form a particle; as well as particles from such admixing.

In a preferred embodiment, particles containing the Cas (eg Cpf1)-gRNA complexes may be formed by mixing Cas (eg Cpf1) protein and one or more gRNAs together, preferably at a 1:1 molar ratio, enzyme: guide RNA. Separately, the different components known to promote delivery of nucleic acids (e.g. DOTAP, DMPC, PEG, and cholesterol) are dissolved, preferably in ethanol. The two solutions are mixed together to form particles containing the Cas (eg Cpf1)-gRNA complexes. After the particles are formed, Cas (eg Cpf1)-gRNA complexes may be transfected into cells (e.g. HSCs). Bar coding may be applied. The particles, the Cas-9 and/or the gRNA may be barcoded.

The invention in an embodiment comprehends a method of preparing an gRNA-and-Cas (eg Cpf1) protein containing particle comprising admixing an gRNA and Cas (eg Cpf1) protein mixture with a mixture comprising or consisting essentially of or consisting of surfactant, phospholipid, biodegradable polymer, lipoprotein and alcohol. An embodiment comprehends an gRNA-and-Cas (eg Cpf1) protein containing particle from the method. The invention in an embodiment comprehends use of the particle in a method of modifying a genomic locus of interest, or an organism or a non-human organism by manipulation of a target sequence in a genomic locus of interest, comprising contacting a cell containing the genomic locus of interest with the particle wherein the gRNA targets the genomic locus of interest; or a method of modifying a genomic locus of interest, or an organism or a non-human organism by manipulation of a target sequence in a genomic locus of interest, comprising contacting a cell containing the genomic locus of interest with the particle wherein the gRNA targets the genomic locus of interest. In these embodiments, the genomic locus of interest is advantageously a genomic locus in an HSC.

Considerations for Therapeutic Applications: A consideration in genome editing therapy is the choice of sequence-specific nuclease, such as a variant of a Cpf1 nuclease. Each nuclease variant may possess its own unique set of strengths and weaknesses, many of which must be balanced in the context of treatment to maximize therapeutic benefit. Thus far, two therapeutic editing approaches with nucleases have shown significant promise: gene disruption and gene correction. Gene disruption involves stimulation of NHEJ to create targeted indels in genetic elements, often resulting in loss of function mutations that are beneficial to patients. In contrast, gene correction uses HDR to directly reverse a disease causing mutation, restoring function while preserving physiological regulation of the corrected element. HDR may also be used to insert a therapeutic transgene into a defined 'safe harbor' locus in the genome to recover missing gene function. For a specific editing therapy to be efficacious, a sufficiently high level of modification must be achieved in target cell populations to reverse disease symptoms. This therapeutic modification 'threshold' is determined by the fitness of edited cells following treatment and the amount of gene product necessary to reverse symptoms. With regard to fitness, editing creates three potential outcomes for treated cells relative to their unedited counterparts: increased, neutral, or decreased fitness. In the case of increased fitness, for example in the treatment of SCID-X1, modified hematopoietic progenitor cells selectively expand relative to their unedited counterparts. SCID-X1 is a disease caused by mutations in the IL2RG gene, the function of which is required for proper development of the hematopoietic lymphocyte lineage [Leonard, W. J., et al. Immunological reviews 138, 61-86 (1994); Kaushansky, K. & Williams, W. J. Williams hematology, (McGraw-Hill Medical, New York, 2010)]. In clinical trials with patients who received viral gene therapy for SCID-X1, and a rare example of a spontaneous correction of SCID-X1 mutation, corrected hematopoietic progenitor cells may be able to overcome this developmental block and expand relative to their diseased counterparts to mediate therapy [Bousso, P., et al. Proceedings of the National Academy of Sciences of the United States of America 97, 274-278 (2000); Hacein-Bey-Abina, S., et al. The New England journal of medicine 346, 1185-1193 (2002); Gaspar, H. B., et al. Lancet 364, 2181-2187 (2004)]. In this case, where edited cells possess a selective advantage, even low numbers of edited cells can be amplified through expansion, providing a therapeutic benefit to the patient. In contrast, editing for other hematopoietic diseases, like chronic granulomatous disorder (CGD), would induce no change in fitness for edited hematopoietic progenitor cells, increasing the therapeutic modification threshold. CGD is caused by mutations in genes encoding phagocytic oxidase proteins, which are normally used by neutrophils to generate reactive oxygen species that kill pathogens [Mukherjee, S. & Thrasher, A. J. Gene 525, 174-181 (2013)]. As dysfunction of these genes does not influence hematopoietic progenitor cell fitness or development, but only the ability of a mature hematopoietic cell type to fight infections, there would be likely no preferential expansion of edited cells in this disease. Indeed, no selective advantage for gene corrected cells in CGD has been observed in gene therapy trials, leading to difficulties with long-term cell engraftment [Malech, H. L., et al. Proceedings of the National Academy of Sciences of the United States of America 94, 12133-12138 (1997); Kang, H. J., et al. Molecular therapy: the journal of the American Society of Gene Therapy 19, 2092-2101 (2011)]. As such, significantly higher levels of editing would be required to treat diseases like CGD, where editing creates a neutral fitness advantage, relative to diseases where editing creates increased fitness for target cells. If editing imposes a fitness disadvantage, as would be the case for restoring function to a tumor suppressor gene in cancer cells, modified cells would be outcompeted by their diseased counterparts, causing the benefit of treatment to be low relative to editing rates. This latter class of diseases would be particularly difficult to treat with genome editing therapy.

In addition to cell fitness, the amount of gene product necessary to treat disease also influences the minimal level of therapeutic genome editing that must be achieved to reverse symptoms. Haemophilia B is one disease where a small change in gene product levels can result in significant changes in clinical outcomes. This disease is caused by mutations in the gene encoding factor IX, a protein normally secreted by the liver into the blood, where it functions as a component of the clotting cascade. Clinical severity of haemophilia B is related to the amount of factor IX activity. Whereas severe disease is associated with less than 1% of normal activity, milder forms of the diseases are associated with greater than 1% of factor IX activity [Kaushansky, K. & Williams, W. J. Williams hematology, (McGraw-Hill Medical, New York, 2010); Lofqvist, T., et al. Journal of internal medicine 241, 395-400 (1997)]. This suggests that editing therapies that can restore factor IX expression to even a small percentage of liver cells could have a large impact on clinical outcomes. A study using ZFNs to correct a mouse model of haemophilia B shortly after birth demonstrated that 3-7% correction was sufficient to reverse disease symptoms, providing preclinical evidence for this hypothesis [Li, H., et al. Nature 475, 217-221 (2011)].

Disorders where a small change in gene product levels can influence clinical outcomes and diseases where there is a fitness advantage for edited cells, are ideal targets for genome editing therapy, as the therapeutic modification threshold is low enough to permit a high chance of success given the current technology. Targeting these diseases has now resulted in successes with editing therapy at the preclinical level and a phase I clinical trial. Improvements in DSB repair pathway manipulation and nuclease delivery are needed to extend these promising results to diseases with a neutral fitness advantage for edited cells, or where larger amounts of gene product are needed for treatment. The Table below shows some examples of applications of genome editing to therapeutic models, and the references of the below Table and the documents cited in those references are hereby incorporated herein by reference as if set out in full.

| Disease Type | Nuclease Platform Employed | Therapeutic Strategy | References |
|---|---|---|---|
| Hemophilia B | ZFN | HDR-mediated insertion of correct gene sequence | Li, H., et al. Nature 475, 217-221 (2011) |
| SCID | ZFN | HDR-mediated insertion of correct gene sequence | Genovese, P., et al. Nature 510, 235-240 (2014) |
| Hereditary tyrosinemia | CRISPR | HDR-mediated correction of mutation in liver | Yin, H., et al. Nature biotechnology 32, 551-553 (2014) |

Addressing each of the conditions of the foreging table, using the CRISPR-Cas (eg Cpf1) system to target by either HDR-mediated correction of mutation, or HDR-mediated insertion of correct gene sequence, advantageously via a delivery system as herein, e.g., a particle delivery system, is within the ambit of the skilled person from this disclosure and the knowledge in the art. Thus, an embodiment comprehends contacting a Hemophilia B, SCID (e.g., SCID-X1, ADA-SCID) or Hereditary tyrosinemia mutation-carrying HSC with an gRNA-and-Cas (eg Cpf1) protein containing particle targeting a genomic locus of interest as to Hemophilia B, SCID (e.g., SCID-X1, ADA-SCID) or Hereditary tyrosinemia (e.g., as in Li, Genovese or Yin). The particle also can contain a suitable HDR template to correct the mutation; or the HSC can be contacted with a second particle or a vector that contains or delivers the HDR template. In this regard, it is mentioned that Haemophilia B is an X-linked recessive disorder caused by loss-of-function mutations in the gene encoding Factor IX, a crucial component of the clotting cascade. Recovering Factor IX activity to above 1% of its levels in severely affected individuals can transform the disease into a significantly milder form, as infusion of recombinant Factor IX into such patients prophylactically from a young age to achieve such levels largely ameliorates clinical complications. With the knowledge in the art and the teachings in this disclosure, the skilled person can correct HSCs as to Haemophilia B using a CRISPR-Cas (eg Cpf1) system that targets and corrects the mutation (X-linked recessive disorder caused by loss-of-function mutations in the gene encoding Factor IX) (e.g., with a suitable HDR template that delivers a coding sequence for Factor IX); specifically, the gRNA can target mutation that give rise to Haemophilia B, and the HDR can provide coding for proper expression of Factor IX. An gRNA that targets the mutation-and-Cas (eg Cpf1) protein containing particle is contacted with HSCs carrying the mutation. The particle also can contain a suitable HDR template to correct the mutation for proper expression of Factor IX; or the HSC can be contacted with a second particle or a vector that contains or delivers the HDR template. The so contacted cells can be administered; and optionally treated/expanded; cf. Cartier, discussed herein.

In Cartier, "MINI-SYMPOSIUM: X-Linked Adrenoleukodystrophypa, Hematopoietic Stem Cell Transplantation and Hematopoietic Stem Cell Gene Therapy in X-Linked Adrenoleukodystrophy," Brain Pathology 20 (2010) 857-862, incorporated herein by reference along with the documents it cites, as if set out in full, there is recognition that allogeneic hematopoietic stem cell transplantation (HSCT) was utilized to deliver normal lysosomal enzyme to the brain of a patient with Hurler's disease, and a discussion of HSC gene therapy to treat ALD. In two patients, peripheral CD34+ cells were collected after granulocyte-colony stimulating factor (G-CSF) mobilization and transduced with an myeloproliferative sarcoma virus enhancer, negative control region deleted, d1587rev primer binding site substituted (MND)-ALD lentiviral vector. CD34+ cells from the patients were transduced with the MND-ALD vector during 16 h in the presence of cytokines at low concentrations. Transduced CD34+ cells were frozen after transduction to perform on 5% of cells various safety tests that included in particular three replication-competent lentivirus (RCL) assays. Transduction efficacy of CD34+ cells ranged from 35% to 50% with a mean number of lentiviral integrated copy between 0.65 and 0.70. After the thawing of transduced CD34+ cells, the patients were reinfused with more than 4.106 transduced CD34+ cells/kg following full myeloablation with busulfan and cyclophos-phamide. The patient's HSCs were ablated to favor engraftment of the gene-corrected HSCs. Hematological recovery occurred between days 13 and 15 for the two patients. Nearly complete immunological recovery occurred at 12 months for the first patient, and at 9 months for the second patient. In contrast to using lentivirus, with the knowledge in the art and the teachings in this disclosure, the skilled person can correct HSCs as to ALD using a CRISPR-Cas (Cpf1) system that targets and corrects the mutation (e.g., with a suitable HDR template); specifically, the gRNA can target mutations in ABCD1, a gene located on the X chromosome that codes for ALD, a peroxisomal membrane transporter protein, and the HDR can provide coding for proper expression of the protein. An gRNA that targets the mutation-and-Cas (Cpf1) protein containing particle is contacted with HSCs, e.g., CD34+ cells carrying the mutation as in Cartier. The particle also can contain a suitable HDR template to correct the mutation for expression of the peroxisomal membrane transporter protein; or the HSC can be contacted with a second particle or a vector that contains or delivers the HDR template. The so contacted cells optimally can be treated as in Cartier. The so contacted cells can be administered as in Cartier.

Mention is made of WO 2015/148860, through the teachings herein the invention comprehends methods and materials of these documents applied in conjunction with the teachings herein. In an aspect of blood-related disease gene therapy, methods and compositions for treating beta thalassemia may be adapted to the CRISPR-Cas system of the present invention (see, e.g., WO 2015/148860). In an embodiment, WO 2015/148860 involves the treatment or prevention of beta thalassemia, or its symptoms, e.g., by altering the gene for B-cell CLL/lymphoma 11A (BCL11A). The BCL11A gene is also known as B-cell CLL/lymphoma 11A, BCL11A-L, BCL11A-S, BCL11AXL, CTIP 1, HBFQTL5 and ZNF. BCL11A encodes a zinc-finger protein that is involved in the regulation of globin gene expression. By altering the BCL11A gene (e.g., one or both alleles of the BCL11A gene), the levels of gamma globin can be increased. Gamma globin can replace beta globin in the hemoglobin complex and effectively carry oxygen to tissues, thereby ameliorating beta thalassemia disease phenotypes.

Mention is also made of WO 2015/148863 and through the teachings herein the invention comprehends methods and materials of these documents which may be adapted to the CRISPR-Cas system of the present invention. In an aspect of treating and preventing sickle cell disease, which is an inherited hematologic disease, WO 2015/148863 comprehends altering the BCL11A gene. By altering the BCL11A gene (e.g., one or both alleles of the BCL11A gene), the levels of gamma globin can be increased. Gamma globin can replace beta globin in the hemoglobin complex and effectively carry oxygen to tissues, thereby ameliorating sickle cell disease phenotypes.

In an aspect of the invention, methods and compositions which involve editing a target nucleic acid sequence, or modulating expression of a target nucleic acid sequence, and applications thereof in connection with cancer immunotherapy are comprehended by adapting the CRISPR-Cas system of the present invention. Reference is made to the application of gene therapy in WO 2015/161276 which involves methods and compositions which can be used to affect T-cell proliferation, survival and/or function by altering one or more T-cell expressed genes, e.g., one or more of FAS, BID, CTLA4, PDCD1, CBLB, PTPN6, TRAC and/or TRBC genes. In a related aspect, T-cell proliferation can be affected by altering one or more T-cell expressed genes, e.g., the CBLB and/or PTPN6 gene, FAS and/or BID gene, CTLA4 and/or PDCDI and/or TRAC and/or TRBC gene.

Chimeric antigen receptor (CAR)19 T-cells exhibit anti-leukemic effects in patient malignancies. However, leukemia patients often do not have enough T-cells to collect, meaning that treatment must involve modified T cells from donors. Accordingly, there is interest in establishing a bank of donor T-cells. Qasim et al. ("First Clinical Application of Talen Engineered Universal CAR19 T Cells in B-ALL" ASH 57th Annual Meeting and Exposition, Dec. 5-8, 2015, Abstract 2046 (ash.confex.com/ash/2015/webprogram/Paper81653.html published online November 2015) discusses modifying CAR19 T cells to eliminate the risk of graft-versus-host disease through the disruption of T-cell receptor expression and CD52 targeting. Furthermore, CD52 cells were targeted such that they became insensitive to Alemtuzumab, and thus allowed Alemtuzumab to prevent host-mediated rejection of human leukocyte antigen (HLA) mismatched CAR19 T-cells. Investigators used third generation self-inactivating lentiviral vector encoding a 4g7 CAR19 (CD19 scFv-4-1BB-CD3ζ) linked to RQR8, then electroporated cells with two pairs of TALEN mRNA for multiplex targeting for both the T-cell receptor (TCR) alpha constant chain locus and the CD52 gene locus. Cells which were still expressing TCR following ex vivo expansion were depleted using CliniMacs α/β TCR depletion, yielding a T-cell product (UCART19) with <1% TCR expression, 85% of which expressed CAR19, and 64% becoming CD52 negative. The modified CAR19 T cells were administered to treat a patient's relapsed acute lymphoblastic leukemia. The teachings provided herein provide effective methods for providing modified hematopoietic stem cells and progeny thereof, including but not limited to cells of the myeloid and lymphoid lineages of blood, including T cells, B cells, monocytes, macrophages, neutrophils, basophils, eosinophils, erythrocytes, dendritic cells, and megakaryocytes or platelets, and natural killer cells and their precursors and progenitors. Such cells can be modified by knocking out, knocking in, or otherwise modulating targets, for example to remove or modulate CD52 as described above, and other targets, such as, without limitation, CXCR4, and PD-1. Thus compositions, cells, and method of the invention can be used to modulate immune responses and to treat, without limitation, malignancies, viral infections, and immune disorders, in conjunction with modification of administration of T cells or other cells to patients.

Mention is made of WO 2015/148670 and through the teachings herein the invention comprehends methods and materials of this document applied in conjunction with the teachings herein. In an aspect of gene therapy, methods and compositions for editing of a target sequence related to or in connection with Human Immunodeficiency Virus (HIV) and Acquired Immunodeficiency Syndrome (AIDS) are comprehended. In a related aspect, the invention described herein comprehends prevention and treatment of HIV infection and AIDS, by introducing one or more mutations in the gene for C-C chemokine receptor type 5 (CCR5). The CCR5 gene is also known as CKR5, CCR-5, CD195, CKR-5, CCCKR5, CMKBR5, IDDM22, and CC-CKR-5. In a further aspect, the invention described herein comprehends provide for prevention or reduction of HIV infection and/or prevention or reduction of the ability for HIV to enter host cells, e.g., in subjects who are already infected. Exemplary host cells for HIV include, but are not limited to, CD4 cells, T cells, gut associated lymphatic tissue (GALT), macrophages, dendritic cells, myeloid precursor cell, and microglia. Viral entry into the host cells requires interaction of the viral glycoproteins gp41 and gp120 with both the CD4 receptor and a co-receptor, e.g., CCR5. If a co-receptor, e.g., CCR5, is not present on the surface of the host cells, the virus cannot bind and enter the host cells. The progress of the disease is thus impeded. By knocking out or knocking down CCR5 in the host cells, e.g., by introducing a protective mutation (such as a CCR5 delta 32 mutation), entry of the HIV virus into the host cells is prevented.

X-linked Chronic granulomatous disease (CGD) is a hereditary disorder of host defense due to absent or decreased activity of phagocyte NADPH oxidase. Using a CRISPR-Cas (Cpf1) system that targets and corrects the mutation (absent or decreased activity of phagocyte NADPH oxidase) (e.g., with a suitable HDR template that delivers a coding sequence for phagocyte NADPH oxidase); specifically, the gRNA can target mutation that gives rise to CGD (deficient phagocyte NADPH oxidase), and the HDR can provide coding for proper expression of phagocyte NADPH oxidase. An gRNA that targets the mutation-and-Cas (Cpf1) protein containing particle is contacted with HSCs carrying the mutation. The particle also can contain a suitable HDR template to correct the mutation for proper expression of phagocyte NADPH oxidase; or the HSC can be contacted with a second particle or a vector that contains or delivers the HDR template. The so contacted cells can be administered; and optionally treated/expanded; cf. Cartier.

Fanconi anemia: Mutations in at least 15 genes (FANCA, FANCB, FANCC, FANCD1/BRCA2, FANCD2, FANCE, FANCF, FANCG, FANCI, FANCJ/BACH1/BRIP1, FANCL/PHF9/POG, FANCM, FANCN/PALB2, FANCO/Rad51C, and FANCP/SLX4/BTBD12) can cause Fanconi anemia. Proteins produced from these genes are involved in a cell process known as the FA pathway. The FA pathway is turned on (activated) when the process of making new copies of DNA, called DNA replication, is blocked due to DNA damage. The FA pathway sends certain proteins to the area of damage, which trigger DNA repair so DNA replication can continue. The FA pathway is particularly responsive to a certain type of DNA damage known as interstrand cross-links (ICLs). ICLs occur when two DNA building blocks (nucleotides) on opposite strands of DNA are abnormally attached or linked together, which stops the process of DNA replication. ICLs can be caused by a buildup of toxic substances produced in the body or by treatment with certain cancer therapy drugs. Eight proteins associated with Fanconi anemia group together to form a complex known as the FA core complex. The FA core complex activates two proteins, called FANCD2 and FANCI. The activation of these two proteins brings DNA repair proteins to the area of the ICL so the cross-link can be removed and DNA replication can continue. the FA core complex. More in particular, the FA core complex is a nuclear multiprotein complex consisting of FANCA, FANCB, FANCC, FANCE, FANCF, FANCG, FANCL, and FANCM, functions as an E3 ubiquitin ligase and mediates the activation of the ID complex, which is a heterodimer composed of FANCD2 and FANCI. Once monoubiquitinated, it interacts with classical tumor suppressors downstream of the FA pathway including FANCD1/BRCA2, FANCN/PALB2, FANCJ/BRIP1, and FANCO/Rad51C and thereby contributes to DNA repair via homologous recombination (HR). Eighty to 90 percent of FA cases are due to mutations in one of three genes, FANCA, FANCC, and FANCG. These genes provide instructions for producing components of the FA core complex. Mutations in such genes associated with the FA core complex will cause the complex to be nonfunctional and disrupt the entire FA pathway. As a result, DNA damage is not repaired efficiently and ICLs build up over time. Geiselhart, "Review Article, Disrupted Signaling through the Fanconi Anemia Pathway Leads to Dysfunctional Hematopoietic Stem Cell Biology: Underlying Mechanisms and Potential Therapeutic Strategies," Anemia Volume 2012 (2012), Article ID 265790, dx.doi.org/10.1155/2012/265790 discussed FA and an animal experiment involving intrafemoral injection of a lentivirus encoding the FANCC gene resulting in correction of HSCs in vivo. Using a CRISPR-Cas (Cpf1) system that targets and one or more of the mutations associated with FA, for instance a CRISPR-Cas (Cpf1) system having gRNA(s) and HDR template(s) that respectively targets one or more of the mutations of FANCA, FANCC, or FANCG that give rise to FA and provide corrective expression of one or more of FANCA, FANCC or FANCG; e.g., the gRNA can target a mutation as to FANCC, and the HDR can provide coding for proper expression of FANCC. An gRNA that targets the mutation(s) (e.g., one or more involved in FA, such as mutation(s) as to any one or more of FANCA, FANCC or FANCG)-and-Cas (Cpf1) protein containing particle is contacted with HSCs carrying the mutation(s). The particle also can contain a suitable HDR template(s) to correct the mutation for proper expression of one or more of the proteins involved in FA, such as any one or more of FANCA, FANCC or FANCG; or the HSC can be contacted with a second particle or a vector that contains or delivers the HDR template. The so contacted cells can be administered; and optionally treated/expanded; cf. Cartier.

The particle in the herein discussion (e.g., as to containing gRNA(s) and Cas (Cpf1), optionally HDR template(s), or HDR template(s); for instance as to Hemophilia B, SCID, SCID-X1, ADA-SCID, Hereditary tyrosinemia, β-thalassemia, X-linked CGD, Wiskott-Aldrich syndrome, Fanconi anemia, adrenoleukodystrophy (ALD), metachromatic leukodystrophy (MLD), HIV/AIDS, Immunodeficiency disorder, Hematologic condition, or genetic lysosomal storage disease) is advantageously obtained or obtainable from admixing an gRNA(s) and Cas (Cpf1) protein mixture (optionally containing HDR template(s) or such mixture only containing HDR template(s) when separate particles as to template(s) is desired) with a mixture comprising or consisting essentially of or consisting of surfactant, phospholipid, biodegradable polymer, lipoprotein and alcohol (wherein one or more gRNA targets the genetic locus or loci in the HSC).

Indeed, the invention is especially suited for treating hematopoietic genetic disorders with genome editing, and immunodeficiency disorders, such as genetic immunodeficiency disorders, especially through using the particle technology herein-discussed. Genetic immunodeficiencies are diseases where genome editing interventions of the instant invention can successful. The reasons include: Hematopoietic cells, of which immune cells are a subset, are therapeutically accessible. They can be removed from the body and transplanted autologously or allogenically. Further, certain genetic immunodeficiencies, e.g., severe combined immunodeficiency (SCID), create a proliferative disadvantage for immune cells. Correction of genetic lesions causing SCID by rare, spontaneous 'reverse' mutations indicates that correcting even one lymphocyte progenitor may be sufficient to recover immune function in patients . . . / . . . / . . . / Users/t_kowalski/AppData/Local/Microsoft/Windows/Temporary Internet Files/Content.Outlook/GA8VY8LK/Treating SCID for Ellen.docx-_ENREF_1 See Bousso, P., et al. Diversity, functionality, and stability of the T cell repertoire derived in vivo from a single human T cell precursor. Proceedings of the National Academy of Sciences of the United States of America 97, 274-278 (2000). The selective advantage for edited cells allows for even low levels of editing to result in a therapeutic effect. This effect of the instant invention can be seen in SCID, Wiskott-Aldrich Syndrome, and the other conditions mentioned herein, including other genetic hematopoietic disorders such as alpha- and beta-thalassemia, where hemoglobin deficiencies negatively affect the fitness of erythroid progenitors.

The activity of NHEJ and HDR DSB repair varies significantly by cell type and cell state. NHEJ is not highly regulated by the cell cycle and is efficient across cell types, allowing for high levels of gene disruption in accessible target cell populations. In contrast, HDR acts primarily during S/G2 phase, and is therefore restricted to cells that are actively dividing, limiting treatments that require precise genome modifications to mitotic cells [Ciccia, A. & Elledge, S. J. Molecular cell 40, 179-204 (2010); Chapman, J. R., et al. Molecular cell 47, 497-510 (2012)].

The efficiency of correction via HDR may be controlled by the epigenetic state or sequence of the targeted locus, or the specific repair template configuration (single vs. double stranded, long vs. short homology arms) used [Hacein-Bey-Abina, S., et al. The New England journal of medicine 346, 1185-1193 (2002); Gaspar, H. B., et al. Lancet 364, 2181-2187 (2004); Beumer, K. J., et al. G3 (2013)]. The relative activity of NHEJ and HDR machineries in target cells may also affect gene correction efficiency, as these pathways may compete to resolve DSBs [Beumer, K. J., et al. Proceedings of the National Academy of Sciences of the United States of America 105, 19821-19826 (2008)]. HDR also imposes a delivery challenge not seen with NHEJ strategies, as it requires the concurrent delivery of nucleases and repair templates. In practice, these constraints have so far led to low levels of HDR in therapeutically relevant cell types. Clinical translation has therefore largely focused on NHEJ strategies to treat disease, although proof-of-concept preclinical HDR treatments have now been described for mouse models of haemophilia B and hereditary tyrosinemia [Li, H., et al. Nature 475, 217-221 (2011); Yin, H., et al. Nature biotechnology 32, 551-553 (2014)].

Any given genome editing application may comprise combinations of proteins, small RNA molecules, and/or repair templates, making delivery of these multiple parts substantially more challenging than small molecule therapeutics. Two main strategies for delivery of genome editing tools have been developed: ex vivo and in vivo. In ex vivo treatments, diseased cells are removed from the body, edited and then transplanted back into the patient. Ex vivo editing has the advantage of allowing the target cell population to be well defined and the specific dosage of therapeutic molecules delivered to cells to be specified. The latter consideration may be particularly important when off-target modifications are a concern, as titrating the amount of nuclease may decrease such mutations (Hsu et al., 2013). Another advantage of ex vivo approaches is the typically high editing rates that can be achieved, due to the development of efficient delivery systems for proteins and nucleic acids into cells in culture for research and gene therapy applications.

There may be drawbacks with ex vivo approaches that limit application to a small number of diseases. For instance, target cells must be capable of surviving manipulation outside the body. For many tissues, like the brain, culturing cells outside the body is a major challenge, because cells either fail to survive, or lose properties necessary for their function in vivo. Thus, in view of this disclosure and the knowledge in the art, ex vivo therapy as to tissues with adult stem cell populations amenable to ex vivo culture and manipulation, such as the hematopoietic system, by the CRISPR-Cas (Cpf1) system are enabled. [Bunn, H. F. & Aster, J. Pathophysiology of blood disorders, (McGraw-Hill, New York, 2011)]

In vivo genome editing involves direct delivery of editing systems to cell types in their native tissues. In vivo editing allows diseases in which the affected cell population is not amenable to ex vivo manipulation to be treated. Furthermore, delivering nucleases to cells in situ allows for the treatment of multiple tissue and cell types. These properties probably allow in vivo treatment to be applied to a wider range of diseases than ex vivo therapies.

To date, in vivo editing has largely been achieved through the use of viral vectors with defined, tissue-specific tropism. Such vectors are currently limited in terms of cargo carrying capacity and tropism, restricting this mode of therapy to organ systems where transduction with clinically useful vectors is efficient, such as the liver, muscle and eye [Kotterman, M. A. & Schaffer, D. V. Nature reviews. Genetics 15, 445-451 (2014); Nguyen, T. H. & Ferry, N. Gene therapy 11 Suppl 1, S76-84 (2004); Boye, S. E., et al. Molecular therapy: the journal of the American Society of Gene Therapy 21, 509-519 (2013)].

A potential barrier for in vivo delivery is the immune response that may be created in response to the large amounts of virus necessary for treatment, but this phenomenon is not unique to genome editing and is observed with other virus based gene therapies [Bessis, N., et al. Gene therapy 11 Suppl 1, S10-17 (2004)]. It is also possible that peptides from editing nucleases themselves are presented on MHC Class I molecules to stimulate an immune response, although there is little evidence to support this happening at the preclinical level. Another major difficulty with this mode of therapy is controlling the distribution and consequently the dosage of genome editing nucleases in vivo, leading to off-target mutation profiles that may be difficult to predict. However, in view of this disclosure and the knowledge in the art, including the use of virus- and particle-based therapies being used in the treatment of cancers, in vivo modification of HSCs, for instance by delivery by either particle or virus, is within the ambit of the skilled person.

Ex Vivo Editing Therapy: The long standing clinical expertise with the purification, culture and transplantation of hematopoietic cells has made diseases affecting the blood system such as SCID, Fanconi anemia, Wiskott-Aldrich syndrome and sickle cell anemia the focus of ex vivo editing therapy. Another reason to focus on hematopoietic cells is that, thanks to previous efforts to design gene therapy for blood disorders, delivery systems of relatively high efficiency already exist. With these advantages, this mode of therapy can be applied to diseases where edited cells possess a fitness advantage, so that a small number of engrafted, edited cells can expand and treat disease. One such disease is HIV, where infection results in a fitness disadvantage to CD4+ T cells.

Ex vivo editing therapy has been recently extended to include gene correction strategies. The barriers to HDR ex vivo were overcome in a recent paper from Genovese and colleagues, who achieved gene correction of a mutated IL2RG gene in hematopoietic stem cells (HSCs) obtained from a patient suffering from SCID-X1 [Genovese, P., et al. Nature 510, 235-240 (2014)]. Genovese et. al. accomplished gene correction in HSCs using a multimodal strategy. First, HSCs were transduced using integration-deficient lentivirus containing an HDR template encoding a therapeutic cDNA for IL2RG. Following transduction, cells were electroporated with mRNA encoding ZFNs targeting a mutational hotspot in IL2RG to stimulate HDR based gene correction. To increase HDR rates, culture conditions were optimized with small molecules to encourage HSC division. With optimized culture conditions, nucleases and HDR templates, gene corrected HSCs from the SCID-X1 patient were obtained in culture at therapeutically relevant rates. HSCs from unaffected individuals that underwent the same gene correction procedure could sustain long-term hematopoiesis in mice, the gold standard for HSC function. HSCs are capable of giving rise to all hematopoietic cell types and can be autologously transplanted, making them an extremely valuable cell population for all hematopoietic genetic disorders [Weissman, I. L. & Shizuru, J. A. Blood 112, 3543-3553 (2008)]. Gene corrected HSCs could, in principle, be used to treat a wide range of genetic blood disorders making this study an exciting breakthrough for therapeutic genome editing.

In Vivo Editing Therapy: In vivo editing can be used advantageously from this disclosure and the knowledge in the art. For organ systems where delivery is efficient, there have already been a number of exciting preclinical therapeutic successes. The first example of successful in vivo editing therapy was demonstrated in a mouse model of haemophilia B [Li, H., et al. Nature 475, 217-221 (2011)]. As noted earlier, Haemophilia B is an X-linked recessive disorder caused by loss-of-function mutations in the gene encoding Factor IX, a crucial component of the clotting cascade. Recovering Factor IX activity to above 1% of its levels in severely affected individuals can transform the disease into a significantly milder form, as infusion of recombinant Factor IX into such patients prophylactically from a young age to achieve such levels largely ameliorates clinical complications [Lofqvist, T., et al. Journal of internal medicine 241, 395-400 (1997)]. Thus, only low levels of HDR gene correction are necessary to change clinical outcomes for patients. In addition, Factor IX is synthesized and secreted by the liver, an organ that can be transduced efficiently by viral vectors encoding editing systems.

Using hepatotropic adeno-associated viral (AAV) serotypes encoding ZFNs and a corrective HDR template, up to 7% gene correction of a mutated, humanized Factor IX gene in the murine liver was achieved [Li, H., et al. Nature 475, 217-221 (2011)]. This resulted in improvement of clot formation kinetics, a measure of the function of the clotting cascade, demonstrating for the first time that in vivo editing therapy is not only feasible, but also efficacious. As discussed herein, the skilled person is positioned from the teachings herein and the knowledge in the art, e.g., Li to address Haemophilia B with a particle-containing HDR template and a CRISPR-Cas (Cpf1) system that targets the mutation of the X-linked recessive disorder to reverse the loss-of-function mutation.

Building on this study, other groups have recently used in vivo genome editing of the liver with CRISPR-Cas to successfully treat a mouse model of hereditary tyrosinemia and to create mutations that provide protection against cardiovascular disease. These two distinct applications demonstrate the versatility of this approach for disorders that involve hepatic dysfunction [Yin, H., et al. Nature biotechnology 32, 551-553 (2014); Ding, Q., et al. Circulation research 115, 488-492 (2014)]. Application of in vivo editing to other organ systems are necessary to prove that this strategy is widely applicable. Currently, efforts to optimize both viral and non-viral vectors are underway to expand the range of disorders that can be treated with this mode of therapy [Kotterman, M. A. & Schaffer, D. V. Nature reviews. Genetics 15, 445-451 (2014); Yin, H., et al. Nature reviews. Genetics 15, 541-555 (2014)]. As discussed herein, the skilled person is positioned from the teachings herein and the knowledge in the art, e.g., Yin to address hereditary tyrosinemia with a particle-containing HDR template and a CRISPR-Cas (Cpf1) system that targets the mutation.

Targeted deletion, therapeutic applications: Targeted deletion of genes may be preferred. Preferred are, therefore, genes involved in immunodeficiency disorder, hematologic condition, or genetic lysosomal storage disease, e.g., Hemophilia B, SCID, SCID-X1, ADA-SCID, Hereditary tyrosinemia, β-thalassemia, X-linked CGD, Wiskott-Aldrich syndrome, Fanconi anemia, adrenoleukodystrophy (ALD), metachromatic leukodystrophy (MLD), HIV/AIDS, other metabolic disorders, genes encoding mis-folded proteins involved in diseases, genes leading to loss-of-function involved in diseases; generally, mutations that can be targeted in an HSC, using any herein-discussed delivery system, with the particle system considered advantageous.

In the present invention, the immunogenicity of the CRISPR enzyme in particular may be reduced following the approach first set out in Tangri et al with respect to erythropoietin and subsequently developed. Accordingly, directed evolution or rational design may be used to reduce the immunogenicity of the CRISPR enzyme (for instance a Cpf1) in the host species (human or other species).

Genome editing: The CRISPR/Cas (Cpf1) systems of the present invention can be used to correct genetic mutations that were previously attempted with limited success using TALEN and ZFN and lentiviruses, including as herein discussed; see also WO2013163628.

Treating Disease of the Brain, Central Nervous and Immune Systems

The present invention also contemplates delivering the CRISPR-Cas system to the brain or neurons. For example, RNA interference (RNAi) offers therapeutic potential for this disorder by reducing the expression of HTT, the disease-causing gene of Huntington's disease (see, e.g., McBride et al., Molecular Therapy vol. 19 no. 12 Dec. 2011, pp. 2152-2162), therefore Applicant postulates that it may be used/and or adapted to the CRISPR-Cas system. The CRISPR-Cas system may be generated using an algorithm to reduce the off-targeting potential of antisense sequences. The CRISPR-Cas sequences may target either a sequence in exon 52 of mouse, rhesus or human huntingtin and expressed in a viral vector, such as AAV. Animals, including humans, may be injected with about three microinjections per hemisphere (six injections total): the first 1 mm rostral to the anterior commissure (12 µl) and the two remaining injections (12 µl and 10 µl, respectively) spaced 3 and 6 mm caudal to the first injection with 1e12 vg/ml of AAV at a rate of about 1 µl/minute, and the needle was left in place for an additional 5 minutes to allow the injectate to diffuse from the needle tip.

DiFiglia et al. (PNAS, Oct. 23, 2007, vol. 104, no. 43, 17204-17209) observed that single administration into the adult striatum of an siRNA targeting Htt can silence mutant Htt, attenuate neuronal pathology, and delay the abnormal behavioral phenotype observed in a rapid-onset, viral transgenic mouse model of HD. DiFiglia injected mice intristriatally with 2 µl of Cy3-labeled cc-siRNA-Htt or unconjugated siRNA-Htt at 10 µM. A similar dosage of CRISPR Cas targeted to Htt may be contemplated for humans in the present invention, for example, about 5-10 ml of 10 µM CRISPR Cas targeted to Htt may be injected intrastriatally.

In another example, Boudreau et al. (Molecular Therapy vol. 17 no. 6 Jun. 2009) injects 5 µl of recombinant AAV serotype 2/1 vectors expressing htt-specific RNAi virus (at $4 \times 10^{12}$ viral genomes/ml) into the straiatum. A similar dosage of CRISPR Cas targeted to Htt may be contemplated for humans in the present invention, for example, about 10-20 ml of $4 \times 10^{12}$ viral genomes/ml) CRISPR Cas targeted to Htt may be injected intrastriatally.

In another example, a CRISPR Cas targeted to HTT may be administered continuously (see, e.g., Yu et al., Cell 150, 895-908, Aug. 31, 2012). Yu et al. utilizes osmotic pumps delivering 0.25 ml/hr (Model 2004) to deliver 300 mg/day of ss-siRNA or phosphate-buffered saline (PBS) (Sigma Aldrich) for 28 days, and pumps designed to deliver 0.5 µl/hr (Model 2002) were used to deliver 75 mg/day of the positive control MOE ASO for 14 days. Pumps (Durect Corporation) were filled with ss-siRNA or MOE diluted in sterile PBS and then incubated at 37 C for 24 or 48 (Model 2004) hours prior to implantation. Mice were anesthetized with 2.5% isofluorane, and a midline incision was made at the base of the skull. Using stereotaxic guides, a cannula was implanted into the right lateral ventricle and secured with Loctite adhesive. A catheter attached to an Alzet osmotic mini pump was attached to the cannula, and the pump was placed subcutaneously in the midscapular area. The incision was closed with 5.0 nylon sutures. A similar dosage of CRISPR Cas targeted to Htt may be contemplated for humans in the present invention, for example, about 500 to 1000 g/day CRISPR Cas targeted to Htt may be administered.

In another example of continuous infusion, Stiles et al. (Experimental Neurology 233 (2012) 463-471) implanted an intraparenchymal catheter with a titanium needle tip into the right putamen. The catheter was connected to a SynchroMed® II Pump (Medtronic Neurological, Minneapolis, MN) subcutaneously implanted in the abdomen. After a 7 day infusion of phosphate buffered saline at 6 µL/day, pumps were re-filled with test article and programmed for continuous delivery for 7 days. About 2.3 to 11.52 mg/d of siRNA were infused at varying infusion rates of about 0.1 to 0.5 µL/min. A similar dosage of CRISPR Cas targeted to Htt may be contemplated for humans in the present invention, for example, about 20 to 200 mg/day CRISPR Cas targeted to Htt may be administered. In another example, the methods of US Patent Publication No. 20130253040 assigned to Sangamo may also be also be adapted from TALES to the nucleic acid-targeting system of the present invention for treating Huntington's Disease. In another example, the methods of US Patent Publication No. 20130253040 (WO2013130824) assigned to Sangamo may also be also be adapted from TALES to the CRISPR Cas system of the present invention for treating Huntington's Disease.

WO2015089354 A1 in the name of The Broad Institute et al., hereby incorporated by reference, describes a targets for Huntington's Disease (HP). Possible target genes of CRISPR complex in regard to Huntington's Disease: PRKCE; IGF1; EP300; RCOR1; PRKCZ; HDAC4; and TGM2. Accordingly, one or more of PRKCE; IGF1; EP300; RCOR1; PRKCZ; HDAC4; and TGM2 may be selected as targets for Huntington's Disease in some embodiments of the present invention. Other trinucleotide repeat disorders. These may include any of the following: Category I includes Huntington's disease (HD) and the spinocerebellar ataxias; Category II expansions are phenotypically diverse with heterogeneous expansions that are generally small in magnitude, but also found in the exons of genes; and Category III includes fragile X syndrome, myotonic dystrophy, two of the spinocerebellar ataxias, juvenile myoclonic epilepsy, and Friedreich's ataxia.

A further aspect of the invention relates to utilizing the CRISPR-Cas system for correcting defects in the EMP2A and EMP2B genes that have been identified to be associated with Lafora disease. Lafora disease is an autosomal recessive condition which is characterized by progressive myoclonus epilepsy which may start as epileptic seizures in adolescence. A few cases of the disease may be caused by mutations in genes yet to be identified. The disease causes seizures, muscle spasms, difficulty walking, dementia, and eventually death. There is currently no therapy that has proven effective against disease progression. Other genetic abnormalities associated with epilepsy may also be targeted by the CRISPR-Cas system and the underlying genetics is further described in Genetics of Epilepsy and Genetic Epilepsies, edited by Giuliano Avanzini, Jeffrey L. Noebels, Mariani Foundation Paediatric Neurology:20; 2009).

The methods of US Patent Publication No. 20110158957 assigned to Sangamo BioSciences, Inc. involved in inactivating T cell receptor (TCR) genes may also be modified to the CRISPR Cas system of the present invention. In another example, the methods of US Patent Publication No. 20100311124 assigned to Sangamo BioSciences, Inc. and US Patent Publication No. 20110225664 assigned to Cellectis, which are both involved in inactivating glutamine synthetase gene expression genes may also be modified to the CRISPR Cas system of the present invention. Delivery options for the brain include encapsulation of CRISPR enzyme and guide RNA in the form of either DNA or RNA into liposomes and conjugating to molecular Trojan horses for trans-blood brain barrier (BBB) delivery. Molecular Trojan horses have been shown to be effective for delivery of B-gal expression vectors into the brain of non-human primates. The same approach can be used to delivery vectors containing CRISPR enzyme and guide RNA. For instance, Xia C F and Boado R J, Pardridge WM ("Antibody-mediated targeting of siRNA via the human insulin receptor using avidin-biotin technology." Mol Pharm. 2009 May-June; 6(3):747-51. doi: 10.1021/mp800194) describes how delivery of short interfering RNA (siRNA) to cells in culture, and in vivo, is possible with combined use of a receptor-specific monoclonal antibody (mAb) and avidin-biotin technology. The authors also report that because the bond between the targeting mAb and the siRNA is stable with avidin-biotin technology, and RNAi effects at distant sites such as brain are observed in vivo following an intravenous administration of the targeted siRNA.

Zhang et al. (Mol Ther. 2003 January; 7(1):11-8.)) describe how expression plasmids encoding reporters such as luciferase were encapsulated in the interior of an "artificial virus" comprised of an 85 nm pegylated immunoliposome, which was targeted to the rhesus monkey brain in vivo with a monoclonal antibody (MAb) to the human insulin receptor (HIR). The HIRMAb enables the liposome carrying the exogenous gene to undergo transcytosis across the blood-brain barrier and endocytosis across the neuronal plasma membrane following intravenous injection. The level of luciferase gene expression in the brain was 50-fold higher in the rhesus monkey as compared to the rat. Widespread neuronal expression of the beta-galactosidase gene in primate brain was demonstrated by both histochemistry and confocal microscopy. The authors indicate that this approach makes feasible reversible adult transgenics in 24 hours. Accordingly, the use of immunoliposome is preferred. These may be used in conjunction with antibodies to target specific tissues or cell surface proteins.

Alzheimer's Disease

US Patent Publication No. 20110023153, describes use of zinc finger nucleases to genetically modify cells, animals and proteins associated with Alzheimer's Disease. Once modified cells and animals may be further tested using known methods to study the effects of the targeted mutations on the development and/or progression of AD using measures commonly used in the study of AD—such as, without limitation, learning and memory, anxiety, depression, addiction, and sensory motor functions as well as assays that measure behavioral, functional, pathological, metaboloic and biochemical function.

The present disclosure comprises editing of any chromosomal sequences that encode proteins associated with AD. The AD-related proteins are typically selected based on an experimental association of the AD-related protein to an AD disorder. For example, the production rate or circulating concentration of an AD-related protein may be elevated or depressed in a population having an AD disorder relative to a population lacking the AD disorder. Differences in protein levels may be assessed using proteomic techniques including but not limited to Western blot, immunohistochemical staining, enzyme linked immunosorbent assay (ELISA), and mass spectrometry. Alternatively, the AD-related proteins may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Examples of Alzheimer's disease associated proteins may include the very low density lipoprotein receptor protein (VLDLR) encoded by the VLDLR gene, the ubiquitin-like modifier activating enzyme 1 (UBA1) encoded by the UBA1 gene, or the NEDD8-activating enzyme E1 catalytic subunit protein (UBE1C) encoded by the UBA3 gene, for example.

By way of non-limiting example, proteins associated with AD include but are not limited to the proteins listed as follows: Chromosomal Sequence Encoded Protein ALAS2 Delta-aminolevulinate synthase 2 (ALAS2) ABCA1 ATP-binding cassette transporter (ABCA1) ACE Angiotensin I-converting enzyme (ACE) APOE Apolipoprotein E precursor (APOE) APP amyloid precursor protein (APP) AQP1 aquaporin 1 protein (AQP1) BIN1 Myc box-dependent-interacting protein 1 or bridging integrator 1 protein (BIN1) BDNF brain-derived neurotrophic factor (BDNF) BTNL8 Butyrophilin-like protein 8 (BTNL8) C1ORF49 chromosome 1 open reading frame 49 CDH4 Cadherin-4 CHRNB2 Neuronal acetylcholine receptor subunit beta-2 CKLFSF2 CKLF-like MARVEL transmembrane domain-containing protein 2 (CKLFSF2) CLEC4E C-type lectin domain family 4, member e (CLEC4E) CLU clusterin protein (also known as apolipoprotein J) CR1 Erythrocyte complement receptor 1 (CR1, also known as CD35, C3b/C4b receptor and immune adherence receptor) CR1L Erythrocyte complement receptor 1 (CR1L) CSF3R granulocyte colony-stimulating factor 3 receptor (CSF3R) CST3 Cystatin C or cystatin 3 CYP2C Cytochrome P450 2C DAPK1 Death-associated protein kinase 1 (DAPK1) ESR1 Estrogen receptor 1 FCAR Fc fragment of IgA receptor (FCAR, also known as CD89) FCGR3B Fc fragment of IgG, low affinity IIIb, receptor (FCGR3B or CD16b) FFA2 Free fatty acid receptor 2 (FFA2) FGA Fibrinogen (Factor I) GAB2 GRB2-associated-binding protein 2 (GAB2) GAB2 GRB2-associated-binding protein 2 (GAB2) GALP Galanin-like peptide GAPDHS Glyceraldehyde-3-phosphate dehydrogenase, spermatogenic (GAPDHS) GMPB GMBP HP Haptoglobin (HP) HTR7 5-hydroxytryptamine (serotonin) receptor 7 (adenylate cyclase-coupled) IDE Insulin degrading enzyme IF127 IF127 IFI6 Interferon, alpha-inducible protein 6 (IFI6) IFIT2 Interferon-induced protein with tetratricopeptide repeats 2 (IFIT2) IL1RN interleukin-1 receptor antagonist (IL-IRA) IL8RA Interleukin 8 receptor, alpha (IL8RA or CD181) IL8RB Interleukin 8 receptor, beta (IL8RB) JAG1 Jagged 1 (JAG1) KCNJ15 Potassium inwardly-rectifying channel, subfamily J, member 15 (KCNJ15) LRP6 Low-density lipoprotein receptor-related protein 6 (LRP6) MAPT microtubule-associated protein tau (MAPT) MARK4 MAP/microtubule affinity-regulating kinase 4 (MARK4) MPHOSPH1 M-phase phosphoprotein 1 MTHFR 5,10-methylenetetrahydrofolate reductase MX2 Interferon-induced GTP-binding protein Mx2 NBN Nibrin, also known as NBN NCSTN Nicastrin NIACR2 Niacin receptor 2 (NIACR2, also known as GPR109B) NMNAT3 nicotinamide nucleotide adenylyltransferase 3 NTM Neurotrimin (or HNT) ORM1 Orosmucoid 1 (ORM1) or Alpha-1-acid glycoprotein 1 P2RY13 P2Y purinoceptor 13 (P2RY13) PBEF1 Nicotinamide phosphoribosyltransferase (NAmPRTase or Nampt) also known as pre-B-cell colony-enhancing factor 1 (PBEF1) or visfatin PCK1 Phosphoenolpyruvate carboxykinase PICALM phosphatidylinositol binding clathrin assembly protein (PICALM) PLAU Urokinase-type plasminogen activator (PLAU) PLXNC1 Plexin C1 (PLXNC1) PRNP Prion protein PSEN1 presenilin 1 protein (PSEN1) PSEN2 presenilin 2 protein (PSEN2) PTPRA protein tyrosine phosphatase receptor type A protein (PTPRA) RALGPS2 Ral GEF with PH domain and SH3 binding motif 2 (RALGPS2) RGSL2 regulator of G-protein signaling like 2 (RGSL2) SELENBP1 Selenium binding protein 1 (SELENBP1) SLC25A37 Mitoferrin-1 SORL1 sortilin-related receptor L (DLR class) A repeats-containing protein (SORL1) TF Transferrin TFAM Mitochondrial transcription factor A TNF Tumor necrosis factor TNFRSF10C Tumor necrosis factor receptor superfamily member 10C (TNFRSF10C) TNFSF10 Tumor necrosis factor receptor superfamily, (TRAIL) member 10a (TNFSF10) UBA1 ubiquitin-like modifier activating enzyme 1 (UBA1) UBA3 NEDD8-activating enzyme E1 catalytic subunit protein (UBE1C) UBB ubiquitin B protein (UBB) UBQLN1 Ubiquilin-1 UCHL1 ubiquitin carboxyl-terminal esterase L1 protein (UCHL1) UCHL3 ubiquitin carboxyl-terminal hydrolase isozyme L3 protein (UCHL3) VLDLR very low density lipoprotein receptor protein (VLDLR)

In exemplary embodiments, the proteins associated with AD whose chromosomal sequence is edited may be the very low density lipoprotein receptor protein (VLDLR) encoded by the VLDLR gene, the ubiquitin-like modifier activating enzyme 1 (UBA1) encoded by the UBA1 gene, the NEDD8-activating enzyme E1 catalytic subunit protein (UBE1C) encoded by the UBA3 gene, the aquaporin 1 protein (AQP1) encoded by the AQP1 gene, the ubiquitin carboxyl-terminal esterase L1 protein (UCHL1) encoded by the UCHL1 gene, the ubiquitin carboxyl-terminal hydrolase isozyme L3 protein (UCHL3) encoded by the UCHL3 gene, the ubiquitin B protein (UBB) encoded by the UBB gene, the microtubule-associated protein tau (MAPT) encoded by the MAPT gene, the protein tyrosine phosphatase receptor type A protein (PTPRA) encoded by the PTPRA gene, the phosphatidylinositol binding clathrin assembly protein (PICALM) encoded by the PICALM gene, the clusterin protein (also known as apolipoprotein J) encoded by the CLU gene, the presenilin 1 protein encoded by the PSEN1 gene, the presenilin 2 protein encoded by the PSEN2 gene, the sortilin-related receptor L (DLR class) A repeats-containing protein (SORL1) protein encoded by the SORL1 gene, the amyloid precursor protein (APP) encoded by the APP gene, the Apolipoprotein E precursor (APOE) encoded by the APOE gene, or the brain-derived neurotrophic factor (BDNF) encoded by the BDNF gene. In an exemplary embodiment, the genetically modified animal is a rat, and the edited chromosomal sequence encoding the protein associated with AD is as follows: APP amyloid precursor protein (APP) NM_019288 AQP1 aquaporin 1 protein (AQP1) NM_012778 BDNF Brain-derived neurotrophic factor NM_012513 CLU clusterin protein (also known as NM_053021 apolipoprotein J) MAPT microtubule-associated protein NM_017212 tau (MAPT) PICALM phosphatidylinositol binding NM_053554 clathrin assembly protein (PICALM) PSEN1 presenilin 1 protein (PSEN1) NM_019163 PSEN2 presenilin 2 protein (PSEN2) NM_031087 PTPRA protein tyrosine phosphatase NM_012763 receptor type A protein (PTPRA) SORL1 sortilin-related receptor L (DLR NM_053519, class) A repeats-containing XM_001065506, protein (SORL1) XM_217115 UBA1 ubiquitin-like modifier activating NM_001014080 enzyme 1 (UBA1) UBA3 NEDD8-activating enzyme E1 NM_057205 catalytic subunit protein (UBE1C) UBB ubiquitin B protein (UBB) NM_138895 UCHL1 ubiquitin carboxyl-terminal NM_017237 esterase L1 protein (UCHL1) UCHL3 ubiquitin carboxyl-terminal NM_001110165 hydrolase isozyme L3 protein (UCHL3) VLDLR very low density lipoprotein NM_013155 receptor protein (VLDLR)

The animal or cell may comprise 1, 2, 3, 4, 5, 6, 7, 8, 9, 10, 11, 12, 13, 14, 15 or more disrupted chromosomal sequences encoding a protein associated with AD and zero, 1, 2, 3, 4, 5, 6, 7, 8, 9, 10, 11, 12, 13, 14, 15 or more chromosomally integrated sequences encoding a protein associated with AD.

The edited or integrated chromosomal sequence may be modified to encode an altered protein associated with AD. A number of mutations in AD-related chromosomal sequences have been associated with AD. For instance, the V7171 (i.e. valine at position 717 is changed to isoleucine) missense mutation in APP causes familial AD. Multiple mutations in the presenilin-1 protein, such as H163R (i.e. histidine at position 163 is changed to arginine), A246E (i.e. alanine at position 246 is changed to glutamate), L286V (i.e. leucine at position 286 is changed to valine) and C410Y (i.e. cysteine at position 410 is changed to tyrosine) cause familial Alzheimer's type 3. Mutations in the presenilin-2 protein, such as N141 I (i.e. asparagine at position 141 is changed to isoleucine), M239V (i.e. methionine at position 239 is changed to valine), and D439A (i.e. aspartate at position 439 is changed to alanine) cause familial Alzheimer's type 4. Other associations of genetic variants in AD-associated genes and disease are known in the art. See, for example, Waring et al. (2008) Arch. Neurol. 65:329-334, the disclosure of which is incorporated by reference herein in its entirety.

Secretase Disorders

US Patent Publication No. 20110023146, describes use of zinc finger nucleases to genetically modify cells, animals and proteins associated with secretase-associated disorders. Secretases are essential for processing pre-proteins into their biologically active forms. Defects in various components of the secretase pathways contribute to many disorders, particularly those with hallmark amyloidogenesis or amyloid plaques, such as Alzheimer's disease (AD).

A secretase disorder and the proteins associated with these disorders are a diverse set of proteins that effect susceptibility for numerous disorders, the presence of the disorder, the severity of the disorder, or any combination thereof. The present disclosure comprises editing of any chromosomal sequences that encode proteins associated with a secretase disorder. The proteins associated with a secretase disorder are typically selected based on an experimental association of the secretase-related proteins with the development of a secretase disorder. For example, the production rate or circulating concentration of a protein associated with a secretase disorder may be elevated or depressed in a population with a secretase disorder relative to a population without a secretase disorder. Differences in protein levels may be assessed using proteomic techniques including but not limited to Western blot, immunohistochemical staining, enzyme linked immunosorbent assay (ELISA), and mass spectrometry. Alternatively, the protein associated with a secretase disorder may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of non-limiting example, proteins associated with a secretase disorder include PSENEN (presenilin enhancer 2 homolog (*C. elegans*)), CTSB (cathepsin B), PSEN1 (presenilin 1), APP (amyloid beta (A4) precursor protein), APH1B (anterior pharynx defective 1 homolog B (*C. elegans*)), PSEN2 (presenilin 2 (Alzheimer disease 4)), BACE1 (beta-site APP-cleaving enzyme 1), ITM2B (integral membrane protein 2B), CTSD (cathepsin D), NOTCH1 (Notch homolog 1, translocation-associated (*Drosophila*)), TNF (tumor necrosis factor (TNF superfamily, member 2)), INS (insulin), DYT10 (dystonia 10), ADAM17 (ADAM metallopeptidase domain 17), APOE (apolipoprotein E), ACE (angiotensin I converting enzyme (peptidyl-dipeptidase A) 1), STN (statin), TP53 (tumor protein p53), IL6 (interleukin 6 (interferon, beta 2)), NGFR (nerve growth factor receptor (TNFR superfamily, member 16)), ILIB (interleukin 1, beta), ACHE (acetylcholinesterase (Yt blood group)), CTNNB1 (catenin (cadherin-associated protein), beta 1, 88 kDa), IGF1 (insulin-like growth factor 1 (somatomedin C)), IFNG (interferon, gamma), NRG1 (neuregulin 1), CASP3 (caspase 3, apoptosis-related cysteine peptidase), MAPK1 (mitogen-activated protein kinase 1), CDH1 (cadherin 1, type 1, E-cadherin (epithelial)), APBB1 (amyloid beta (A4) precursor protein-binding, family B, member 1 (Fe65)), HMGCR (3-hydroxy-3-methylglutaryl-Coenzyme A reductase), CREB1 (cAMP responsive element binding protein 1), PTGS2 (prostaglandin-endoperoxide synthase 2 (prostaglandin G/H synthase and cyclooxygenase)), HES1 (hairy and enhancer of split 1, (*Drosophila*)), CAT (catalase), TGFB1 (transforming growth factor, beta 1), ENO2 (enolase 2 (gamma, neuronal)), ERBB4 (v-erb-a erythroblastic leukemia viral oncogene homolog 4 (avian)), TRAPPC10 (trafficking protein particle complex 10), MAOB (monoamine oxidase B), NGF (nerve growth factor (beta polypeptide)), MMP12 (matrix metallopeptidase 12 (macrophage elastase)), JAG1 (jagged 1 (Alagille syndrome)), CD40LG (CD40 ligand), PPARG (peroxisome proliferator-activated receptor gamma), FGF2 (fibroblast growth factor 2 (basic)), IL3 (interleukin 3 (colony-stimulating factor, multiple)), LRP1 (low density lipoprotein receptor-related protein 1), NOTCH4 (Notch homolog 4 (*Drosophila*)), MAPK8 (mitogen-activated protein kinase 8), PREP (prolyl endopeptidase), NOTCH3 (Notch homolog 3 (*Drosophila*)), PRNP (prion protein), CTSG (cathepsin G), EGF (epidermal growth factor (beta-urogastrone)), REN (renin), CD44 (CD44 molecule (Indian blood group)), SELP (selectin P (granule membrane protein 140 kDa, antigen CD62)), GHR (growth hormone receptor), ADCYAP1 (adenylate cyclase activating polypeptide 1 (pituitary)), INSR (insulin receptor), GFAP (glial fibrillary acidic protein), MMP3 (matrix metallopeptidase 3 (stromelysin 1, progelatinase)), MAPK10 (mitogen-activated protein kinase 10), SP1 (Sp1 transcription factor), MYC (v-myc myelocytomatosis viral oncogene homolog (avian)), CTSE (cathepsin E), PPARA (peroxisome proliferator-activated receptor alpha), JUN (jun oncogene), TIMP1 (TIMP metallopeptidase inhibitor 1), IL5 (interleukin 5 (colony-stimulating factor, eosinophil)), ILIA (interleukin 1, alpha), MMP9 (matrix metallopeptidase 9 (gelatinase B, 92 kDa gelatinase, 92 kDa type IV collagenase)), HTR4 (5-hydroxytryptamine (serotonin) receptor 4), HSPG2 (heparan sulfate proteoglycan 2), KRAS (v-Ki-ras2 Kirsten rat sarcoma viral oncogene homolog), CYCS (cytochrome c, somatic), SMG1 (SMG1 homolog, phosphatidylinositol 3-kinase-related kinase (*C. elegans*)), IL1R1 (interleukin 1 receptor, type I), PROK1 (prokineticin 1), MAPK3 (mitogen-activated protein kinase 3), NTRK1 (neurotrophic tyrosine kinase, receptor, type 1), IL13 (interleukin 13), MME (membrane metallo-endopeptidase), TKT (transketolase), CXCR2 (chemokine (C-X-C motif) receptor 2), IGF1R (insulin-like growth factor 1 receptor), RARA (retinoic acid receptor, alpha), CREBBP (CREB binding protein), PTGS1 (prostaglandin-endoperoxide synthase 1 (prostaglandin G/H synthase and cyclooxygenase)), GALT (galactose-1-phosphate uridylyltransferase), CHRM1 (cholinergic receptor, muscarinic 1), ATXN1 (ataxin 1), PAWR (PRKC, apoptosis, WT1, regulator), NOTCH2 (Notch homolog 2 (*Drosophila*)), M6PR (mannose-6-phosphate receptor (cation dependent)), CYP46A1 (cytochrome P450, family 46, subfamily A, polypeptide 1), CSNK1 D (casein kinase 1, delta), MAPK14 (mitogen-activated protein kinase 14), PRG2 (proteoglycan 2, bone marrow (natural killer cell activator, eosinophil granule major basic protein)), PRKCA (protein kinase C, alpha), Li CAM (Li cell adhesion molecule), CD40 (CD40 molecule, TNF receptor superfamily member 5), NR1I2 (nuclear receptor subfamily 1, group I, member 2), JAG2 (jagged 2), CTNND1 (catenin (cadherin-associated protein), delta 1), CDH2 (cadherin 2, type 1, N-cadherin (neuronal)), CMA1 (chymase 1, mast cell), SORT1 (sortilin 1), DLK1 (delta-like 1 homolog (*Drosophila*)), THEM4 (thioesterase superfamily member 4), JUP (junction plakoglobin), CD46 (CD46 molecule, complement regulatory protein), CCL11 (chemokine (C-C motif) ligand 11), CAV3 (caveolin 3), RNASE3 (ribonuclease, RNase A family, 3 (eosinophil cationic protein)), HSPA8 (heat shock 70 kDa protein 8), CASP9 (caspase 9, apoptosis-related cysteine peptidase), CYP3A4 (cytochrome P450, family 3, subfamily A, polypeptide 4), CCR3 (chemokine (C-C motif) receptor 3), TFAP2A (transcription factor AP-2 alpha (activating enhancer binding protein 2 alpha)), SCP2 (sterol carrier protein 2), CDK4 (cyclin-dependent kinase 4), HIF1A (hypoxia inducible factor 1, alpha subunit (basic helix-loop-helix transcription factor)), TCF7L2 (transcription factor 7-like 2 (T-cell specific, HMG-box)), IL1R2 (interleukin 1 receptor, type II), B3GALTL (beta 1,3-galactosyltransferase-like), MDM2 (Mdm2 p53 binding protein homolog (mouse)), RELA (v-rel reticuloendotheliosis viral oncogene homolog A (avian)), CASP7 (caspase 7, apoptosis-related cysteine peptidase), IDE (insulin-degrading enzyme), FABP4 (fatty acid binding protein 4, adipocyte), CASK (calcium/calmodulin-dependent serine protein kinase (MAGUK family)), ADCYAPR1R1 (adenylate cyclase activating polypeptide 1 (pituitary) receptor type I), ATF4 (activating transcription factor 4 (tax-responsive enhancer element B67)), PDGFA (platelet-derived growth factor alpha polypeptide), C21 or f33 (chromosome 21 open reading frame 33), SCG5 (secretogranin V (7B2 protein)), RNF123 (ring finger protein 123), NFKB1 (nuclear factor of kappa light polypeptide gene enhancer in B-cells 1), ERBB2 (v-erb-b2 erythroblastic leukemia viral oncogene homolog 2, neuro/glioblastoma derived oncogene homolog (avian)), CAV1 (caveolin 1, caveolae protein, 22 kDa), MMP7 (matrix metallopeptidase 7 (matrilysin, uterine)), TGFA (transforming growth factor, alpha), RXRA (retinoid X receptor, alpha), STX1A (syntaxin 1A (brain)), PSMC4 (proteasome (prosome, macropain) 26S subunit, ATPase, 4), P2RY2 (purinergic receptor P2Y, G-protein coupled, 2), TNFRSF21 (tumor necrosis factor receptor superfamily, member 21), DLG1 (discs, large homolog 1 (*Drosophila*)), NUMBL (numb homolog (*Drosophila*)-like), SPN (sialophorin), PLSCR1 (phospholipid scramblase 1), UBQLN2 (ubiquilin 2), UBQLN1 (ubiquilin 1), PCSK7 (proprotein convertase subtilisin/kexin type 7), SPON1 (spondin 1, extracellular matrix protein), SILV (silver homolog (mouse)), QPCT (glutaminyl-peptide cyclotransferase), HESS (hairy and enhancer of split 5 (*Drosophila*)), GCC1 (GRIP and coiled-coil domain containing 1), and any combination thereof.

The genetically modified animal or cell may comprise 1, 2, 3, 4, 5, 6, 7, 8, 9, 10 or more disrupted chromosomal sequences encoding a protein associated with a secretase disorder and zero, 1, 2, 3, 4, 5, 6, 7, 8, 9, 10 or more chromosomally integrated sequences encoding a disrupted protein associated with a secretase disorder.

ALS

US Patent Publication No. 20110023144, describes use of zinc finger nucleases to genetically modify cells, animals and proteins associated with amyotrophyic lateral sclerosis (ALS) disease. ALS is characterized by the gradual steady degeneration of certain nerve cells in the brain cortex, brain stem, and spinal cord involved in voluntary movement.

Motor neuron disorders and the proteins associated with these disorders are a diverse set of proteins that effect susceptibility for developing a motor neuron disorder, the presence of the motor neuron disorder, the severity of the motor neuron disorder or any combination thereof. The present disclosure comprises editing of any chromosomal sequences that encode proteins associated with ALS disease, a specific motor neuron disorder. The proteins associated with ALS are typically selected based on an experimental association of ALS-related proteins to ALS. For example, the production rate or circulating concentration of a protein associated with ALS may be elevated or depressed in a population with ALS relative to a population without ALS. Differences in protein levels may be assessed using proteomic techniques including but not limited to Western blot, immunohistochemical staining, enzyme linked immunosorbent assay (ELISA), and mass spectrometry. Alternatively, the proteins associated with ALS may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of non-limiting example, proteins associated with ALS include but are not limited to the following proteins: SOD1 superoxide dismutase 1, ALS3 amyotrophic lateral soluble sclerosis 3 SETX senataxin ALS5 amyotrophic lateral sclerosis 5 FUS fused in sarcoma ALS7 amyotrophic lateral sclerosis 7 ALS2 amyotrophic lateral DPP6 Dipeptidyl-peptidase 6 sclerosis 2 NEFH neurofilament, heavy PTGS1 prostaglandin-polypeptide endoperoxide synthase 1 SLC1A2 solute carrier family 1 TNFRSF10B tumor necrosis factor (glial high affinity receptor superfamily, glutamate transporter), member 10b member 2 PRPH peripherin HSP90AAI heat shock protein 90 kDa alpha (cytosolic), class A member 1 GRIA2 glutamate receptor, IFNG interferon, gamma ionotropic, AMPA 2 S100B S100 calcium binding FGF2 fibroblast growth factor 2 protein B AOX1 aldehyde oxidase 1 CS citrate synthase TARDBP TAR DNA binding protein TXN thioredoxin RAPH1 Ras association MAP3K5 mitogen-activated protein (RalGDS/AF-6) and kinase 5 pleckstrin homology domains 1 NBEAL1 neurobeachin-like 1 GPX1 glutathione peroxidase 1 ICA1L islet cell autoantigen RAC1 ras-related C3 botulinum 1.69 kDa-like toxin substrate 1 MAPT microtubule-associated ITPR2 inositol 1,4,5-protein tau triphosphate receptor, type 2 ALS2CR4 amyotrophic lateral GLS glutaminase sclerosis 2 (juvenile) chromosome region, candidate 4 ALS2CR8 amyotrophic lateral CNTFR ciliary neurotrophic factor sclerosis 2 (juvenile) receptor chromosome region, candidate 8 ALS2CR11 amyotrophic lateral FOLH1 folate hydrolase 1 sclerosis 2 (juvenile) chromosome region, candidate 11 FAM117B family with sequence P4HB prolyl 4-hydroxylase, similarity 117, member B beta polypeptide CNTF ciliary neurotrophic factor SQSTM1 sequestosome 1 STRADB STE20-related kinase NAIP NLR family, apoptosis adaptor beta inhibitory protein YWHAQ tyrosine 3-SLC33A1 solute carrier family 33 monooxygenase/tryptoph (acetyl-CoA transporter), an 5-monooxygenase member 1 activation protein, theta polypeptide TRAK2 trafficking protein, FIG. 4 FIG. 4 homolog, SAC1 kinesin binding 2 lipid phosphatase domain containing NIF3L1 NIF3 NGG1 interacting INA internexin neuronal factor 3-like 1 intermediate filament protein, alpha PARD3B par-3 partitioning COX8A cytochrome c oxidase defective 3 homolog B subunit VIIIA CDK15 cyclin-dependent kinase HECW1 HECT, C2 and WW 15 domain containing E3 ubiquitin protein ligase 1 NOS1 nitric oxide synthase 1 MET met proto-oncogene SOD2 superoxide dismutase 2, HSPB1 heat shock 27 kDa mitochondrial protein 1 NEFL neurofilament, light CTSB cathepsin B polypeptide ANG angiogenin, HSPA8 heat shock 70 kDa ribonuclease, RNase A protein 8 family, 5 VAPB VAMP (vesicle-ESR1 estrogen receptor 1 associated membrane protein)-associated protein B and C SNCA synuclein, alpha HGF hepatocyte growth factor CAT catalase ACTB actin, beta NEFM neurofilament, medium TH tyrosine hydroxylase polypeptide BCL2 B-cell CLL/lymphoma 2 FAS Fas (TNF receptor superfamily, member 6) CASP3 caspase 3, apoptosis-CLU clusterin related cysteine peptidase SMN1 survival of motor neuron G6PD glucose-6-phosphate 1, telomeric dehydrogenase BAX BCL2-associated X HSF1 heat shock transcription protein factor 1 RNF19A ring finger protein 19A JUN jun oncogene ALS2CR12 amyotrophic lateral HSPA5 heat shock 70 kDa sclerosis 2 (juvenile) protein 5 chromosome region, candidate 12 MAPK14 mitogen-activated protein IL10 interleukin 10 kinase 14 APEX1 APEX nuclease TXNRD1 thioredoxin reductase 1 (multifunctional DNA repair enzyme) 1 NOS2 nitric oxide synthase 2, TIMP1 TIMP metallopeptidase inducible inhibitor 1 CASP9 caspase 9, apoptosis-XIAP X-linked inhibitor of related cysteine apoptosis peptidase GLG1 golgi glycoprotein 1 EPO erythropoietin VEGFA vascular endothelial ELN elastin growth factor A GDNF glial cell derived NFE2L2 nuclear factor (erythroid-neurotrophic factor derived 2)-like 2 SLC6A3 solute carrier family 6 HSPA4 heat shock 70 kDa (neurotransmitter protein 4 transporter, dopamine), member 3 APOE apolipoprotein E PSMB8 proteasome (prosome, macropain) subunit, beta type, 8 DCTN1 dynactin 1 TIMP3 TIMP metallopeptidase inhibitor 3 KIFAP3 kinesin-associated SLC1A1 solute carrier family I protein 3 (neuronal/epithelial high affinity glutamate transporter, system Xag), member 1 SMN2 survival of motor neuron CCNC cyclin C 2, centromeric MPP4 membrane protein, STUB1 STIP1 homology and U-palmitoylated 4 box containing protein 1 ALS2 amyloid beta (A4) PRDX6 peroxiredoxin 6 precursor protein SYP synaptophysin CABIN1 calcineurin binding protein 1 CASP1 caspase 1, apoptosis-GART phosphoribosylglycinami related cysteine de formyltransferase, peptidase phosphoribosylglycinami de synthetase, phosphoribosylaminoimi dazole synthetase CDK5 cyclin-dependent kinase 5 ATXN3 ataxin 3 RTN4 reticulon 4 C1QB complement component 1, q subcomponent, B chain VEGFC nerve growth factor HTT huntingtin receptor PARK7 Parkinson disease 7 XDH xanthine dehydrogenase GFAP glial fibrillary acidic MAP2 microtubule-associated protein protein 2 CYCS cytochrome c, somatic FCGR3B Fc fragment of IgG, low affinity IIIb, CCS copper chaperone for UBL5 ubiquitin-like 5 superoxide dismutase MMP9 matrix metallopeptidase SLC18A3 solute carrier family 18 9 ((vesicular acetylcholine), member 3 TRPM7 transient receptor HSPB2 heat shock 27 kDa potential cation channel, protein 2 subfamily M, member 7 AKT1 v-akt murine thymoma DERL1 Derl-like domain family, viral oncogene homolog 1 member 1 CCL2 chemokine (C-C motif) NGRN neugrin, neurite ligand 2 outgrowth associated GSR glutathione reductase TPPP3 tubulin polymerization-promoting protein family member 3 APAF1 apoptotic peptidase BTBD10 BTB (POZ) domain activating factor 1 containing 10 GLUD1 glutamate CXCR4 chemokine (C-X-C motif) dehydrogenase 1 receptor 4 SLC1A3 solute carrier family 1 FLT1 fms-related tyrosine (glial high affinity glutamate transporter), member 3 kinase 1 PON1 paraoxonase 1 AR androgen receptor LIF leukemia inhibitory factor ERBB3 v-erb-b2 erythroblastic leukemia viral oncogene homolog 3 LGALS1 lectin, galactoside-CD44 CD44 molecule binding, soluble, 1 TP53 tumor protein p53 TLR3 toll-like receptor 3 GRIA1 glutamate receptor, GAPDH glyceraldehyde-3-ionotropic, AMPA 1 phosphate dehydrogenase GRIK1 glutamate receptor, DES desmin ionotropic, kainate 1 CHAT choline acetyltransferase FLT4 fins-related tyrosine kinase 4 CHMP2B chromatin modifying BAG1 BCL2-associated protein 2B athanogene MT3 metallothionein 3 CHRNA4 cholinergic receptor, nicotinic, alpha 4 GSS glutathione synthetase BAK1 BCL2-antagonist/killer 1 KDR kinase insert domain GSTP1 glutathione S-transferase receptor (a type III pi 1 receptor tyrosine kinase) OGG1 8-oxoguanine DNA IL6 interleukin 6 (interferon, glycosylase beta 2).

The animal or cell may comprise 1, 2, 3, 4, 5, 6, 7, 8, 9, 10 or more disrupted chromosomal sequences encoding a protein associated with ALS and zero, 1, 2, 3, 4, 5, 6, 7, 8, 9, 10 or more chromosomally integrated sequences encoding the disrupted protein associated with ALS. Preferred proteins associated with ALS include SOD1 (superoxide dismutase 1), ALS2 (amyotrophic lateral sclerosis 2), FUS (fused in sarcoma), TARDBP (TAR DNA binding protein), VAGFA (vascular endothelial growth factor A), VAGFB (vascular endothelial growth factor B), and VAGFC (vascular endothelial growth factor C), and any combination thereof.

Autism

US Patent Publication No. 20110023145, describes use of zinc finger nucleases to genetically modify cells, animals and proteins associated with autism spectrum disorders (ASD). Autism spectrum disorders (ASDs) are a group of disorders characterized by qualitative impairment in social interaction and communication, and restricted repetitive and stereotyped patterns of behavior, interests, and activities. The three disorders, autism, Asperger syndrome (AS) and pervasive developmental disorder—not otherwise specified (PDD-NOS) are a continuum of the same disorder with varying degrees of severity, associated intellectual functioning and medical conditions. ASDs are predominantly genetically determined disorders with a heritability of around 90%.

US Patent Publication No. 20110023145 comprises editing of any chromosomal sequences that encode proteins associated with ASD which may be applied to the CRISPR Cas system of the present invention. The proteins associated with ASD are typically selected based on an experimental association of the protein associated with ASD to an incidence or indication of an ASD. For example, the production rate or circulating concentration of a protein associated with ASD may be elevated or depressed in a population having an ASD relative to a population lacking the ASD. Differences in protein levels may be assessed using proteomic techniques including but not limited to Western blot, immunohistochemical staining, enzyme linked immunosorbent assay (ELISA), and mass spectrometry. Alternatively, the proteins associated with ASD may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Non limiting examples of disease states or disorders that may be associated with proteins associated with ASD include autism, Asperger syndrome (AS), pervasive developmental disorder—not otherwise specified (PDD-NOS), Rett's syndrome, tuberous sclerosis, phenylketonuria, Smith-Lemli-Opitz syndrome and fragile X syndrome. By way of non-limiting example, proteins associated with ASD include but are not limited to the following proteins: ATP10C aminophospholipid-MET MET receptor transporting ATPase tyrosine kinase (ATP10C) BZRAP1 MGLUR5 (GRM5) Metabotropic glutamate receptor 5 (MGLUR5) CDH10 Cadherin-10 MGLUR6 (GRM6) Metabotropic glutamate receptor 6 (MGLUR6) CDH9 Cadherin-9 NLGN1 Neuroligin-1 CNTN4 Contactin-4 NLGN2 Neuroligin-2 CNTNAP2 Contactin-associated SEMA5A Neuroligin-3 protein-like 2 (CNTNAP2) DHCR7 7-dehydrocholesterol NLGN4X Neuroligin-4 X-reductase (DHCR7) linked DOC2A Double C2-like domain-NLGN4Y Neuroligin-4 Y-containing protein alpha linked DPP6 Dipeptidyl NLGN5 Neuroligin-5 aminopeptidase-like protein 6 EN2 engrailed 2 (EN2) NRCAM Neuronal cell adhesion molecule (NRCAM) MDGA2 fragile X mental retardation NRXN1 Neurexin-1 1 (MDGA2) FMR2 (AFF2) AF4/FMR2 family member 2 OR4M2 Olfactory receptor (AFF2) 4M2 FOXP2 Forkhead box protein P2 OR4N4 Olfactory receptor (FOXP2) 4N4 FXR1 Fragile X mental OXTR oxytocin receptor retardation, autosomal (OXTR) homolog 1 (FXR1) FXR2 Fragile X mental PAH phenylalanine retardation, autosomal hydroxylase (PAH) homolog 2 (FXR2) GABRA1 Gamma-aminobutyric acid PTEN Phosphatase and receptor subunit alpha-1 tensin homologue (GABRA1) (PTEN) GABRA5 GABAA (.gamma.-aminobutyric PTPRZ1 Receptor-type acid) receptor alpha 5 tyrosine-protein subunit (GABRA5) phosphatase zeta (PTPRZ1) GABRB1 Gamma-aminobutyric acid RELN Reelin receptor subunit beta-1 (GABRB1) GABRB3 GABAA (.gamma.-aminobutyric RPL10 60S ribosomal acid) receptor .beta.3 subunit protein L10 (GABRB3) GABRG1 Gamma-aminobutyric acid SEMA5A Semaphorin-5A receptor subunit gamma-1 (SEMA5A) (GABRG1) HIRIP3 HIRA-interacting protein 3 SEZ6L2 seizure related 6 homolog (mouse)-like 2 HOXA1 Homeobox protein Hox-A1 SHANK3 SH3 and multiple (HOXA1) ankyrin repeat domains 3 (SHANK3) IL6 Interleukin-6 SHBZRAP1 SH3 and multiple ankyrin repeat domains 3 (SHBZRAP1) LAMB1 Laminin subunit beta-1 SLC6A4 Serotonin (LAMB1) transporter (SERT) MAPK3 Mitogen-activated protein TAS2R1 Taste receptor kinase 3 type 2 member 1 TAS2R1 MAZ Myc-associated zinc finger TSC1 Tuberous sclerosis protein protein 1 MDGA2 MAM domain containing TSC2 Tuberous sclerosis glycosylphosphatidylinositol protein 2 anchor 2 (MDGA2) MECP2 Methyl CpG binding UBE3A Ubiquitin protein protein 2 (MECP2) ligase E3A (UBE3A) MECP2 methyl CpG binding WNT2 Wingless-type protein 2 (MECP2) MMTV integration site family, member 2 (WNT2)

The identity of the protein associated with ASD whose chromosomal sequence is edited can and will vary. In preferred embodiments, the proteins associated with ASD whose chromosomal sequence is edited may be the benzodiazapine receptor (peripheral) associated protein 1 (BZ-RAP1) encoded by the BZRAP1 gene, the AF4/FMR2 family member 2 protein (AFF2) encoded by the AFF2 gene (also termed MFR2), the fragile X mental retardation autosomal homolog 1 protein (FXR1) encoded by the FXR1 gene, the fragile X mental retardation autosomal homolog 2 protein (FXR2) encoded by the FXR2 gene, the MAM domain containing glycosylphosphatidylinositol anchor 2 protein (MDGA2) encoded by the MDGA2 gene, the methyl CpG binding protein 2 (MECP2) encoded by the MECP2 gene, the metabotropic glutamate receptor 5 (MGLUR5) encoded by the MGLUR5-1 gene (also termed GRM5), the neurexin 1 protein encoded by the NRXN1 gene, or the semaphorin-5A protein (SEMA5A) encoded by the SEMA5A gene. In an exemplary embodiment, the genetically modified animal is a rat, and the edited chromosomal sequence encoding the protein associated with ASD is as listed below: BZRAP1 benzodiazepine receptor XM_002727789, (peripheral) associated XM_213427, protein 1 (BZRAP1) XM_002724533, XM_001081125 AFF2 (FMR2) AF4/FMR2 family member 2 XM_219832, (AFF2) XM_001054673 FXR1 Fragile X mental NM_001012179 retardation, autosomal homolog 1 (FXR1) FXR2 Fragile X mental NM_001100647 retardation, autosomal homolog 2 (FXR2) MDGA2 MAM domain containing NM_199269 glycosylphosphatidylinositol anchor 2 (MDGA2) MECP2 Methyl CpG binding NM_022673 protein 2 (MECP2) MGLUR5 Metabotropic glutamate NM_017012 (GRM5) receptor 5 (MGLUR5) NRXN1 Neurexin-1 NM_021767 SEMA5A Semaphorin-5A (SEMA5A) NM_001107659.

Trinucleotide Repeat Expansion Disorders

US Patent Publication No. 20110016540, describes use of zinc finger nucleases to genetically modify cells, animals and proteins associated with trinucleotide repeat expansion disorders. Trinucleotide repeat expansion disorders are complex, progressive disorders that involve developmental neurobiology and often affect cognition as well as sensori-motor functions.

Trinucleotide repeat expansion proteins are a diverse set of proteins associated with susceptibility for developing a trinucleotide repeat expansion disorder, the presence of a trinucleotide repeat expansion disorder, the severity of a trinucleotide repeat expansion disorder or any combination thereof. Trinucleotide repeat expansion disorders are divided into two categories determined by the type of repeat. The most common repeat is the triplet CAG, which, when present in the coding region of a gene, codes for the amino acid glutamine (Q). Therefore, these disorders are referred to as the polyglutamine (polyQ) disorders and comprise the following diseases: Huntington Disease (HD); Spinobulbar Muscular Atrophy (SBMA); Spinocerebellar Ataxias (SCA types 1, 2, 3, 6, 7, and 17); and Dentatorubro-Pallidoluysian Atrophy (DRPLA). The remaining trinucleotide repeat expansion disorders either do not involve the CAG triplet or the CAG triplet is not in the coding region of the gene and are, therefore, referred to as the non-polyglutamine disorders. The non-polyglutamine disorders comprise Fragile X Syndrome (FRAXA); Fragile XE Mental Retardation (FRAXE); Friedreich Ataxia (FRDA); Myotonic Dystrophy (DM); and Spinocerebellar Ataxias (SCA types 8, and 12).

The proteins associated with trinucleotide repeat expansion disorders are typically selected based on an experimental association of the protein associated with a trinucleotide repeat expansion disorder to a trinucleotide repeat expansion disorder. For example, the production rate or circulating concentration of a protein associated with a trinucleotide repeat expansion disorder may be elevated or depressed in a population having a trinucleotide repeat expansion disorder relative to a population lacking the trinucleotide repeat expansion disorder. Differences in protein levels may be assessed using proteomic techniques including but not limited to Western blot, immunohistochemical staining, enzyme linked immunosorbent assay (ELISA), and mass spectrometry. Alternatively, the proteins associated with trinucleotide repeat expansion disorders may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Non-limiting examples of proteins associated with trinucleotide repeat expansion disorders include AR (androgen receptor), FMR1 (fragile X mental retardation 1), HTT (huntingtin), DMPK (dystrophia myotonica-protein kinase), FXN (frataxin), ATXN2 (ataxin 2), ATN1 (atrophin 1), FEN1 (flap structure-specific endonuclease 1), TNRC6A (trinucleotide repeat containing 6A), PABPN1 (poly(A) binding protein, nuclear 1), JPH3 (junctophilin 3), MED15 (mediator complex subunit 15), ATXN1 (ataxin 1), ATXN3 (ataxin 3), TBP (TATA box binding protein), CACNA1A (calcium channel, voltage-dependent, P/Q type, alpha 1A subunit), ATXN8OS (ATXN8 opposite strand (non-protein coding)), PPP2R2B (protein phosphatase 2, regulatory subunit B, beta), ATXN7 (ataxin 7), TNRC6B (trinucleotide repeat containing 6B), TNRC6C (trinucleotide repeat containing 6C), CELF3 (CUGBP, Elav-like family member 3), MAB21L1 (mab-21-like 1 (*C. elegans*)), MSH2 (mutS homolog 2, colon cancer, nonpolyposis type 1 (*E. coli*)), TMEM185A (transmembrane protein 185A), SIX5 (SIX homeobox 5), CNPY3 (canopy 3 homolog (zebrafish)), FRAXE (fragile site, folic acid type, rare, fra(X)(q28) E), GNB2 (guanine nucleotide binding protein (G protein), beta polypeptide 2), RPL14 (ribosomal protein L14), ATXN8 (ataxin 8), INSR (insulin receptor), TTR (transthyretin), EP400 (E1A binding protein p400), GIGYF2 (GRB10 interacting GYF protein 2), OGG1 (8-oxoguanine DNA glycosylase), STC1 (stanniocalcin 1), CNDP1 (carnosine dipeptidase 1 (metallopeptidase M20 family)), C10orf2 (chromosome 10 open reading frame 2), MAML3 mastermind-like 3 (*Drosophila*), DKC1 (dyskeratosis congenita 1, dyskerin), PAXIP1 (PAX interacting (with transcription-activation domain) protein 1), CASK (calcium/calmodulin-dependent serine protein kinase (MAGUK family)), MAPT (microtubule-associated protein tau), SP1 (Sp1 transcription factor), POLG (polymerase (DNA directed), gamma), AFF2 (AF4/FMR2 family, member 2), THBS1 (thrombospondin 1), TP53 (tumor protein p53), ESR1 (estrogen receptor 1), CGGBP1 (CGG triplet repeat binding protein 1), ABT1 (activator of basal transcription 1), KLK3 (kallikrein-related peptidase 3), PRNP (prion protein), JUN (jun oncogene), KCNN3 (potassium intermediate/small conductance calcium-activated channel, subfamily N, member 3), BAX (BCL2-associated X protein), FRAXA (fragile site, folic acid type, rare, fra(X)(q27.3) A (macroorchidism, mental retardation)), KBTBD10 (kelch repeat and BTB (POZ) domain containing 10), MBNL1 (muscleblind-like (*Drosophila*)), RAD51 (RAD51 homolog (RecA homolog, *E. coli*) (*S. cerevisiae*)), NCOA3 (nuclear receptor coactivator 3), ERDA1 (expanded repeat domain, CAG/CTG 1), TSC1 (tuberous sclerosis 1), COMP (cartilage oligomeric matrix protein), GCLC (glutamate-cysteine ligase, catalytic subunit), RRAD (Ras-related associated with diabetes), MSH3 (mutS homolog 3 (*E. coli*)), DRD2 (dopamine receptor D2), CD44 (CD44 molecule (Indian blood group)), CTCF (CCCTC-binding factor (zinc finger protein)), CCND1 (cyclin D1), CLSPN (claspin homolog (*Xenopus laevis*)), MEF2A (myocyte enhancer factor 2A), PTPRU (protein tyrosine phosphatase, receptor type, U), GAPDH (glyceraldehyde-3-phosphate dehydrogenase), TRIM22 (tripartite motif-containing 22), WT1 (Wilms tumor 1), AHR (aryl hydrocarbon receptor), GPX1 (glutathione peroxidase 1), TPMT (thiopurine S-methyltransferase), NDP (Norrie disease (pseudoglioma)), ARX (aristaless related homeobox), MUS81 (MUS81 endonuclease homolog (*S. cerevisiae*)), TYR (tyrosinase (oculocutaneous albinism IA)), EGR1 (early growth response 1), UNG (uracil-DNA glycosylase), NUMBL (numb homolog (*Drosophila*)-like), FABP2 (fatty acid binding protein 2, intestinal), EN2 (engrailed homeobox 2), CRYGC (crystallin, gamma C), SRP14 (signal recognition particle 14 kDa (homologous Alu RNA binding protein)), CRYGB (crystallin, gamma B), PDCD1 (programmed cell death 1), HOXA1 (homeobox A1), ATXN2L (ataxin 2-like), PMS2 (PMS2 postmeiotic segregation increased 2 (*S. cerevisiae*)), GLA (galactosidase, alpha), CBL (Cas-Br-M (murine) ecotropic retroviral transforming sequence), FTH1 (ferritin, heavy polypeptide 1), IL12RB2 (interleukin 12 receptor, beta 2), OTX2 (orthodenticle homeobox 2), HOXA5 (homeobox A5), POLG2 (polymerase (DNA directed), gamma 2, accessory subunit), DLX2 (distal-less homeobox 2), SIRPA (signal-regulatory protein alpha), OTX1 (orthodenticle homeobox 1), AHRR (aryl-hydrocarbon receptor repressor), MANF (mesencephalic astrocyte-derived neurotrophic factor), TMEM158 (transmembrane protein 158 (gene/pseudogene)), and ENSG00000078687.

Preferred proteins associated with trinucleotide repeat expansion disorders include HTT (Huntingtin), AR (androgen receptor), FXN (frataxin), Atxn3 (ataxin), Atxn1 (ataxin), Atxn2 (ataxin), Atxn7 (ataxin), Atxn10 (ataxin), DMPK (dystrophia myotonica-protein kinase), Atn1 (atrophin 1), CBP (creb binding protein), VLDLR (very low density lipoprotein receptor), and any combination thereof.

Treating Hearing Diseases

The present invention also contemplates delivering the CRISPR-Cas system to one or both ears. Researchers are looking into whether gene therapy could be used to aid current deafness treatments—namely, cochlear implants. Deafness is often caused by lost or damaged hair cells that cannot relay signals to auditory neurons. In such cases, cochlear implants may be used to respond to sound and transmit electrical signals to the nerve cells. But these neurons often degenerate and retract from the cochlea as fewer growth factors are released by impaired hair cells.

US patent application 20120328580 describes injection of a pharmaceutical composition into the ear (e.g., auricular administration), such as into the luminae of the cochlea (e.g., the Scala media, Sc vestibulae, and Sc tympani), e.g., using a syringe, e.g., a single-dose syringe. For example, one or more of the compounds described herein can be administered by intratympanic injection (e.g., into the middle ear), and/or injections into the outer, middle, and/or inner ear. Such methods are routinely used in the art, for example, for the administration of steroids and antibiotics into human ears. Injection can be, for example, through the round window of the ear or through the cochlear capsule. Other inner ear administration methods are known in the art (see, e.g., Salt and Plontke, Drug Discovery Today, 10:1299-1306, 2005).

In another mode of administration, the pharmaceutical composition can be administered in situ, via a catheter or pump. A catheter or pump can, for example, direct a pharmaceutical composition into the cochlear luminae or the round window of the ear and/or the lumen of the colon. Exemplary drug delivery apparatus and methods suitable for administering one or more of the compounds described herein into an ear, e.g., a human ear, are described by McKenna et al., (U.S. Publication No. 2006/0030837) and Jacobsen et al., (U.S. Pat. No. 7,206,639). In some embodiments, a catheter or pump can be positioned, e.g., in the ear (e.g., the outer, middle, and/or inner ear) of a patient during a surgical procedure. In some embodiments, a catheter or pump can be positioned, e.g., in the ear (e.g., the outer, middle, and/or inner ear) of a patient without the need for a surgical procedure.

Alternatively or in addition, one or more of the compounds described herein can be administered in combination with a mechanical device such as a cochlear implant or a hearing aid, which is worn in the outer ear. An exemplary cochlear implant that is suitable for use with the present invention is described by Edge et al., (U.S. Publication No. 2007/0093878).

In some embodiments, the modes of administration described above may be combined in any order and can be simultaneous or interspersed.

Alternatively or in addition, the present invention may be administered according to any of the Food and Drug Administration approved methods, for example, as described in CDER Data Standards Manual, version number 004 (which is available at fda.give/cder/dsm/DRG/drg00301.htm).

In general, the cell therapy methods described in US patent application 20120328580 can be used to promote complete or partial differentiation of a cell to or towards a mature cell type of the inner ear (e.g., a hair cell) in vitro. Cells resulting from such methods can then be transplanted or implanted into a patient in need of such treatment. The cell culture methods required to practice these methods, including methods for identifying and selecting suitable cell types, methods for promoting complete or partial differentiation of selected cells, methods for identifying complete or partially differentiated cell types, and methods for implanting complete or partially differentiated cells are described below.

Cells suitable for use in the present invention include, but are not limited to, cells that are capable of differentiating completely or partially into a mature cell of the inner ear, e.g., a hair cell (e.g., an inner and/or outer hair cell), when contacted, e.g., in vitro, with one or more of the compounds described herein. Exemplary cells that are capable of differentiating into a hair cell include, but are not limited to stem cells (e.g., inner ear stem cells, adult stem cells, bone marrow derived stem cells, embryonic stem cells, mesenchymal stem cells, skin stem cells, iPS cells, and fat derived stem cells), progenitor cells (e.g., inner ear progenitor cells), support cells (e.g., Deiters' cells, pillar cells, inner phalangeal cells, tectal cells and Hensen's cells), and/or germ cells. The use of stem cells for the replacement of inner ear sensory cells is described in Li et al., (U.S. Publication No. 2005/0287127) and Li et al., (U.S. patent Ser. No. 11/953, 797). The use of bone marrow derived stem cells for the replacement of inner ear sensory cells is described in Edge et al., PCT/US2007/084654. iPS cells are described, e.g., at Takahashi et al., Cell, Volume 131, Issue 5, Pages 861-872 (2007); Takahashi and Yamanaka, Cell 126, 663-76 (2006); Okita et al., Nature 448, 260-262 (2007); Yu, J. et al., Science 318(5858):1917-1920 (2007); Nakagawa et al., Nat. Biotechnol. 26:101-106 (2008); and Zaehres and Scholer, Cell 131(5):834-835 (2007). Such suitable cells can be identified by analyzing (e.g., qualitatively or quantitatively) the presence of one or more tissue specific genes. For example, gene expression can be detected by detecting the protein product of one or more tissue-specific genes. Protein detection techniques involve staining proteins (e.g., using cell extracts or whole cells) using antibodies against the appropriate antigen. In this case, the appropriate antigen is the protein product of the tissue-specific gene expression. Although, in principle, a first antibody (i.e., the antibody that binds the antigen) can be labeled, it is more common (and improves the visualization) to use a second antibody directed against the first (e.g., an anti-IgG). This second antibody is conjugated either with fluorochromes, or appropriate enzymes for colorimetric reactions, or gold beads (for electron microscopy), or with the biotin-avidin system, so that the location of the primary antibody, and thus the antigen, can be recognized.

The CRISPR Cas molecules of the present invention may be delivered to the ear by direct application of pharmaceutical composition to the outer ear, with compositions modified from US Published application, 20110142917. In some embodiments the pharmaceutical composition is applied to the ear canal. Delivery to the ear may also be referred to as aural or otic delivery.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference.

Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-

1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Qi et al. discloses methods for efficient siRNA transfection to the inner ear through the intact round window by a novel proteidic delivery technology which may be applied to the nucleic acid-targeting system of the present invention (see, e.g., Qi et al., Gene Therapy (2013), 1-9). In particular, a TAT double stranded RNA-binding domains (TAT-DRBDs), which can transfect Cy3-labeled siRNA into cells of the inner ear, including the inner and outer hair cells, crista ampullaris, macula utriculi and macula sacculi, through intact round-window permeation was successful for delivering double stranded siRNAs in vivo for treating various inner ear ailments and preservation of hearing function. About 40 μl of 10 mM RNA may be contemplated as the dosage for administration to the ear.

According to Rejali et al. (Hear Res. 2007 June; 228(1-2):180-7), cochlear implant function can be improved by good preservation of the spiral ganglion neurons, which are the target of electrical stimulation by the implant and brain derived neurotrophic factor (BDNF) has previously been shown to enhance spiral ganglion survival in experimentally deafened ears. Rejali et al. tested a modified design of the cochlear implant electrode that includes a coating of fibroblast cells transduced by a viral vector with a BDNF gene insert. To accomplish this type of ex vivo gene transfer, Rejali et al. transduced guinea pig fibroblasts with an adenovirus with a BDNF gene cassette insert, and determined that these cells secreted BDNF and then attached BDNF-secreting cells to the cochlear implant electrode via an agarose gel, and implanted the electrode in the scala tympani. Rejali et al. determined that the BDNF expressing electrodes were able to preserve significantly more spiral ganglion neurons in the basal turns of the cochlea after 48 days of implantation when compared to control electrodes and demonstrated the feasibility of combining cochlear implant therapy with ex vivo gene transfer for enhancing spiral ganglion neuron survival. Such a system may be applied to the nucleic acid-targeting system of the present invention for delivery to the ear.

Mukherjea et al. (Antioxidants & Redox Signaling, Volume 13, Number 5, 2010) document that knockdown of NOX3 using short interfering (si) RNA abrogated cisplatin ototoxicity, as evidenced by protection of OHCs from damage and reduced threshold shifts in auditory brainstem responses (ABRs). Different doses of siNOX3 (0.3, 0.6, and 0.9 μg) were administered to rats and NOX3 expression was evaluated by real time RT-PCR. The lowest dose of NOX3 siRNA used (0.3 μg) did not show any inhibition of NOX3 mRNA when compared to transtympanic administration of scrambled siRNA or untreated cochleae. However, administration of the higher doses of NOX3 siRNA (0.6 and 0.9 μg) reduced NOX3 expression compared to control scrambled siRNA. Such a system may be applied to the CRISPR Cas system of the present invention for transtympanic administration with a dosage of about 2 mg to about 4 mg of CRISPR Cas for administration to a human.

Jung et al. (Molecular Therapy, vol. 21 no. 4, 834-841 April 2013) demonstrate that Hes5 levels in the utricle decreased after the application of siRNA and that the number of hair cells in these utricles was significantly larger than following control treatment. The data suggest that siRNA technology may be useful for inducing repair and regeneration in the inner ear and that the Notch signaling pathway is a potentially useful target for specific gene expression inhibition. Jung et al. injected 8 μg of Hes5 siRNA in 2 μl volume, prepared by adding sterile normal saline to the lyophilized siRNA to a vestibular epithelium of the ear. Such a system may be applied to the nucleic acid-targeting system of the present invention for administration to the vestibular epithelium of the ear with a dosage of about 1 to about 30 mg of CRISPR Cas for administration to a human.

Gene Targeting in Non-Dividing Cells (Neurones & Muscle)

Non-dividing (especially non-dividing, fully differentiated) cell types present issues for gene targeting or genome engineering, for example because homologous recombination (HR) is generally suppressed in the G1 cell-cycle phase. However, while studying the mechanisms by which cells control normal DNA repair systems, Durocher discovered a previously unknown switch that keeps HR "off" in non-dividing cells and devised a strategy to toggle this switch back on. Orthwein et al. (Daniel Durocher's lab at the Mount Sinai Hospital in Ottawa, Canada) recently reported (Nature 16142, published online 9 Dec. 2015) have shown that the suppression of HR can be lifted and gene targeting successfully concluded in both kidney (293T) and osteosarcoma (U20S) cells. Tumor suppressors, BRCA1, PALB2 and BRAC2 are known to promote DNA DSB repair by HR. They found that formation of a complex of BRCA1 with PALB2-BRAC2 is governed by a ubiquitin site on PALB2, such that action on the site by an E3 ubiquitin ligase. This E3 ubiquitin ligase is composed of KEAP1 (a PALB2-interacting protein) in complex with cullin-3 (CUL3)-RBX1. PALB2 ubiquitylation suppresses its interaction with BRCA1 and is counteracted by the deubiquitylase USP11, which is itself under cell cycle control. Restoration of the BRCA1-PALB2 interaction combined with the activation of DNA-end resection is sufficient to induce homologous recombination in G1, as measured by a number of methods including a CRISPR-Cas9-based gene-targeting assay directed at USP11 or KEAP1 (expressed from a pX459 vector). However, when the BRCA1-PALB2 interaction was restored in resection-competent G1 cells using either KEAP1 depletion or expression of the PALB2-KR mutant, a robust increase in gene-targeting events was detected.

Thus, reactivation of HR in cells, especially non-dividing, fully differentiated cell types is preferred, in some embodiments. In some embodiments, promotion of the BRCA1-PALB2 interaction is preferred in some embodiments. In some embodiments, the target ell is a non-dividing cell. In some embodiments, the target cell is a neurone or muscle cell. In some embodiments, the target cell is targeted in vivo. In some embodiments, the cell is in G1 and HR is suppressed. In some embodiments, use of KEAP1 depletion, for example inhibition of expression of KEAP1 activity, is preferred. KEAP1 depletion may be achieved through siRNA, for example as shown in Orthwein et al. Alternatively, expression of the PALB2-KR mutant (lacking all eight Lys residues in the BRCA1-interaction domain is preferred, either in combination with KEAP1 depletion or alone. PALB2-KR interacts with BRCA1 irrespective of cell cycle position. Thus, promotion or restoration of the BRCA1-PALB2 interaction, especially in G1 cells, is preferred in some embodiments, especially where the target cells are non-dividing, or where removal and return (ex vivo gene targeting) is problematic, for example neurone or muscle cells. KEAP1 siRNA is available from ThermoFischer. In some embodiments, a BRCA1-PALB2 complex may be delivered to the G1 cell. In some embodiments, PALB2 deubiquitylation may be promoted for example by increased expression of the deubiquitylase USP11, so it is envisaged that a construct may be provided to promote or up-regulate expression or activity of the deubiquitylase USP11.

Treating Diseases of the Eye

The present invention also contemplates delivering the CRISPR-Cas system to one or both eyes. In yet another aspect of the invention, the CRISPR-Cas system may be used to correct ocular defects that arise from several genetic mutations further described in Genetic Diseases of the Eye, Second Edition, edited by Elias I. Traboulsi, Oxford University Press, 2012.

For administration to the eye, lentiviral vectors, in particular equine infectious anemia viruses (EIAV) are particularly preferred.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285, Published online 21 Nov. 2005 in Wiley InterScience (worldwideweb.interscience.wiley.com). DOI: 10.1002/jgm.845). The vectors are contemplated to have cytomegalovirus (CMV) promoter driving expression of the target gene. Intracameral, subretinal, intraocular and intravitreal injections are all contemplated (see, e.g., Balagaan, J Gene Med 2006; 8: 275-285, Published online 21 Nov. 2005 in Wiley InterScience (worldwideweb.interscience.wiley.com). DOI: 10.1002/jgm.845). Intraocular injections may be performed with the aid of an operating microscope. For subretinal and intravitreal injections, eyes may be prolapsed by gentle digital pressure and fundi visualised using a contact lens system consisting of a drop of a coupling medium solution on the cornea covered with a glass microscope slide coverslip. For subretinal injections, the tip of a 10-mm 34-gauge needle, mounted on a 5-μl Hamilton syringe may be advanced under direct visualisation through the superior equatorial sclera tangentially towards the posterior pole until the aperture of the needle was visible in the subretinal space. Then, 2 μl of vector suspension may be injected to produce a superior bullous retinal detachment, thus confirming subretinal vector administration. This approach creates a self-sealing sclerotomy allowing the vector suspension to be retained in the subretinal space until it is absorbed by the RPE, usually within 48 h of the procedure. This procedure may be repeated in the inferior hemisphere to produce an inferior retinal detachment. This technique results in the exposure of approximately 70% of neurosensory retina and RPE to the vector suspension. For intravitreal injections, the needle tip may be advanced through the sclera 1 mm posterior to the corneoscleral limbus and 2 μl of vector suspension injected into the vitreous cavity. For intracameral injections, the needle tip may be advanced through a corneoscleral limbal paracentesis, directed towards the central cornea, and 2 μl of vector suspension may be injected. For intracameral injections, the needle tip may be advanced through a corneoscleral limbal paracentesis, directed towards the central cornea, and 2 μl of vector suspension may be injected. These vectors may be injected at titres of either $1.0\text{-}1.4\times10^{10}$ or $1.0\text{-}1.4\times10^{9}$ transducing units (TU)/ml.

In another embodiment, RetinoStat®, an equine infectious anemia virus-based lentiviral gene therapy vector that expresses angiostatic proteins endostain and angiostatin that is delivered via a subretinal injection for the treatment of the web form of age-related macular degeneration is also contemplated (see, e.g., Binley et al., HUMAN GENE THERAPY 23:980-991 (September 2012)). Such a vector may be modified for the CRISPR-Cas system of the present invention. Each eye may be treated with either RetinoStat® at a dose of $1.1\times10^{5}$ transducing units per eye (TU/eye) in a total volume of 100 μl.

In another embodiment, an E1-, partial E3-, E4-deleted adenoviral vector may be contemplated for delivery to the eye. Twenty-eight patients with advanced neovascular agerelated macular degeneration (AMD) were given a single intravitreous injection of an E1-, partial E3-, E4-deleted adenoviral vector expressing human pigment ep-ithelium-derived factor (AdPEDF.ll) (see, e.g., Campochiaro et al., Human Gene Therapy 17:167-176 (February 2006)). Doses ranging from $10^{6}$ to $10^{9.5}$ particle units (PU) were investigated and there were no serious adverse events related to AdPEDF.ll and no dose-limiting toxicities (see, e.g., Campochiaro et al., Human Gene Therapy 17:167-176 (February 2006)). Adenoviral vectormediated ocular gene transfer appears to be a viable approach for the treatment of ocular disorders and could be applied to the CRISPR Cas system.

In another embodiment, the sd-rxRNA® system of RXi Pharmaceuticals may be used/and or adapted for delivering CRISPR Cas to the eye. In this system, a single intravitreal administration of 3 μg of sd-rxRNA results in sequence-specific reduction of PPIB mRNA levels for 14 days. The sd-rxRNA® system may be applied to the nucleic acid-targeting system of the present invention, contemplating a dose of about 3 to 20 mg of CRISPR administered to a human.

Millington-Ward et al. (Molecular Therapy, vol. 19 no. 4, 642-649 April 2011) describes adeno-associated virus (AAV) vectors to deliver an RNA interference (RNAi)-based rhodopsin suppressor and a codon-modified rhodopsin replacement gene resistant to suppression due to nucleotide alterations at degenerate positions over the RNAi target site. An injection of either $6.0\times10^{8}$ vp or $1.8\times10^{10}$ vp AAV were subretinally injected into the eyes by Millington-Ward et al. The AAV vectors of Millington-Ward et al. may be applied to the CRISPR Cas system of the present invention, contemplating a dose of about $2\times10^{11}$ to about $6\times10^{13}$ vp administered to a human.

Dalkara et al. (Sci Transl Med 5, 189ra76 (2013)) also relates to in vivo directed evolution to fashion an AAV vector that delivers wild-type versions of defective genes throughout the retina after noninjurious injection into the eyes' vitreous humor. Dalkara describes a 7mer peptide display library and an AAV library constructed by DNA shuffling of cap genes from AAV1, 2, 4, 5, 6, 8, and 9. The rcAAV libraries and rAAV vectors expressing GFP under a CAG or Rho promoter were packaged and deoxyribonuclease-resistant genomic titers were obtained through quantitative PCR. The libraries were pooled, and two rounds of evolution were performed, each consisting of initial library diversification followed by three in vivo selection steps. In each such step, P30 rho-GFP mice were intravitreally injected with 2 ml of iodixanol-purified, phosphate-buffered saline (PBS)-dialyzed library with a genomic titer of about $1\times10^{12}$ vg/ml. The AAV vectors of Dalkara et al. may be applied to the nucleic acid-targeting system of the present invention, contemplating a dose of about $1\times10^{15}$ to about $1\times10^{16}$ vg/ml administered to a human.

In another embodiment, the rhodopsin gene may be targeted for the treatment of retinitis pigmentosa (RP), wherein the system of US Patent Publication No.

20120204282 assigned to Sangamo BioSciences, Inc. may be modified in accordance of the CRISPR Cas system of the present invention.

In another embodiment, the methods of US Patent Publication No. 20130183282 assigned to Cellectis, which is directed to methods of cleaving a target sequence from the human rhodopsin gene, may also be modified to the nucleic acid-targeting system of the present invention.

US Patent Publication No. 20130202678 assigned to Academia *Sinica* relates to methods for treating retinopathies and sight-threatening ophthalmologic disorders relating to delivering of the Puf-A gene (which is expressed in retinal ganglion and pigmented cells of eye tissues and displays a unique anti-apoptotic activity) to the sub-retinal or intravitreal space in the eye. In particular, desirable targets are zgc:193933, prdm1a, spata2, tex10, rbb4, ddx3, zp2.2, Blimp-1 and HtrA2, all of which may be targeted by the nucleic acid-targeting system of the present invention.

Wu (Cell Stem Cell, 13:659-62, 2013) designed a guide RNA that led Cas9 to a single base pair mutation that causes cataracts in mice, where it induced DNA cleavage. Then using either the other wild-type allele or oligos given to the zygotes repair mechanisms corrected the sequence of the broken allele and corrected the cataract-causing genetic defect in mutant mouse.

US Patent Publication No. 20120159653, describes use of zinc finger nucleases to genetically modify cells, animals and proteins associated with macular degeration (MD). Macular degeneration (MD) is the primary cause of visual impairment in the elderly, but is also a hallmark symptom of childhood diseases such as Stargardt disease, Sorsby fundus, and fatal childhood neurodegenerative diseases, with an age of onset as young as infancy. Macular degeneration results in a loss of vision in the center of the visual field (the macula) because of damage to the retina. Currently existing animal models do not recapitulate major hallmarks of the disease as it is observed in humans. The available animal models comprising mutant genes encoding proteins associated with MD also produce highly variable phenotypes, making translations to human disease and therapy development problematic.

One aspect of US Patent Publication No. 20120159653 relates to editing of any chromosomal sequences that encode proteins associated with MD which may be applied to the nucleic acid-targeting system of the present invention. The proteins associated with MD are typically selected based on an experimental association of the protein associated with MD to an MD disorder. For example, the production rate or circulating concentration of a protein associated with MD may be elevated or depressed in a population having an MD disorder relative to a population lacking the MD disorder. Differences in protein levels may be assessed using proteomic techniques including but not limited to Western blot, immunohistochemical staining, enzyme linked immunosorbent assay (ELISA), and mass spectrometry. Alternatively, the proteins associated with MD may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of non-limiting example, proteins associated with MD include but are not limited to the following proteins: (ABCA4) ATP-binding cassette, sub-family A (ABC1), member 4 ACHM1 achromatopsia (rod monochromacy) 1 ApoE Apolipoprotein E (ApoE) C1QTNF5 (CTRP5) C1q and tumor necrosis factor related protein 5 (C1QTNF5) C2 Complement component 2 (C2) C3 Complement components (C3) CCL2 Chemokine (C-C motif) Ligand 2 (CCL2) CCR2 Chemokine (C-C motif) receptor 2 (CCR2) CD36 Cluster of Differentiation 36 CFB Complement factor B CFH Complement factor CFH H CFHR1 complement factor H-related 1 CFHR3 complement factor H-related 3 CNGB3 cyclic nucleotide gated channel beta 3 CP ceruloplasmin (CP) CRP C reactive protein (CRP) CST3 cystatin C or cystatin 3 (CST3) CTSD Cathepsin D (CTSD) CX3CR1 chemokine (C-X3-C motif) receptor 1 ELOVL4 Elongation of very long chain fatty acids 4 ERCC6 excision repair crosscomplementing rodent repair deficiency, complementation group 6 FBLN5 Fibulin-5 FBLN5 Fibulin 5 FBLN6 Fibulin 6 FSCN2 fascin (FSCN2) HMCN1 Hemicentrin 1 HMCN1 hemicentin 1 HTRA1 HtrA serine peptidase 1 (HTRA1) HTRA1 HtrA serine peptidase 1 IL-6 Interleukin 6 IL-8 Interleukin 8 LOC387715 Hypothetical protein PLEKHA1 Pleckstrin homology domaincontaining family A member 1 (PLEKHA1) PROM1 Prominin 1(PROM1 or CD133) PRPH2 Peripherin-2 RPGR retinitis pigmentosa GTPase regulator SERPING1 serpin peptidase inhibitor, clade G, member 1 (C1-inhibitor) TCOF1 Treacle TIMP3 Metalloproteinase inhibitor 3 (TIMP3) TLR3 Toll-like receptor 3.

The identity of the protein associated with MD whose chromosomal sequence is edited can and will vary. In preferred embodiments, the proteins associated with MD whose chromosomal sequence is edited may be the ATP-binding cassette, sub-family A (ABC1) member 4 protein (ABCA4) encoded by the ABCR gene, the apolipoprotein E protein (APOE) encoded by the APOE gene, the chemokine (C-C motif) Ligand 2 protein (CCL2) encoded by the CCL2 gene, the chemokine (C-C motif) receptor 2 protein (CCR2) encoded by the CCR2 gene, the ceruloplasmin protein (CP) encoded by the CP gene, the cathepsin D protein (CTSD) encoded by the CTSD gene, or the metalloproteinase inhibitor 3 protein (TIMP3) encoded by the TIMP3 gene. In an exemplary embodiment, the genetically modified animal is a rat, and the edited chromosomal sequence encoding the protein associated with MD may be: (ABCA4) ATPbinding cassette, NM_000350 sub-family A (ABC1), member 4 APOE Apolipoprotein E NM_138828 (APOE) CCL2 Chemokine (C-C NM_031530 motif) Ligand 2 (CCL2) CCR2 Chemokine (C-C NM_021866 motif) receptor 2 (CCR2) CP ceruloplasmin (CP) NM_012532 CTSD Cathepsin D (CTSD) NM 134334 TIMP3 Metalloproteinase NM_012886 inhibitor 3 (TIMP3) The animal or cell may comprise 1, 2, 3, 4, 5, 6, 7 or more disrupted chromosomal sequences encoding a protein associated with MD and zero, 1, 2, 3, 4, 5, 6, 7 or more chromosomally integrated sequences encoding the disrupted protein associated with MD.

The edited or integrated chromosomal sequence may be modified to encode an altered protein associated with MD. Several mutations in MD-related chromosomal sequences have been associated with MD. Non-limiting examples of mutations in chromosomal sequences associated with MD include those that may cause MD including in the ABCR protein, E471K (i.e. glutamate at position 471 is changed to lysine), R1129L (i.e. arginine at position 1129 is changed to leucine), T1428M (i.e. threonine at position 1428 is changed to methionine), R1517S (i.e. arginine at position 1517 is changed to serine), I1562T (i.e. isoleucine at position 1562 is changed to threonine), and G1578R (i.e. glycine at position 1578 is changed to arginine); in the CCR2 protein, V64I (i.e. valine at position 192 is changed to isoleucine); in CP protein, G969B (i.e. glycine at position 969 is changed to asparagine or aspartate); in TIMP3 protein, S156C (i.e. serine at position 156 is changed to cysteine), G166C (i.e. glycine at position 166 is changed to cysteine), G167C (i.e. glycine at position 167 is changed to cysteine), Y168C (i.e. tyrosine at position 168 is changed to cysteine), S170C (i.e. serine at position 170 is changed to cysteine), Y172C (i.e. tyrosine at position 172 is changed to cysteine) and S181C (i.e. serine at position 181 is changed to cysteine). Other associations of genetic variants in MD-associated genes and disease are known in the art.

Treating Circulatory and Muscular Diseases

The present invention also contemplates delivering the CRISPR-Cas system described herein, e.g. Cpf1 effector protein systems, to the heart. For the heart, a myocardium tropic adena-associated virus (AAVM) is preferred, in particular AAVM41 which showed preferential gene transfer in the heart (see, e.g., Lin-Yanga et al., PNAS, Mar. 10, 2009, vol. 106, no. 10). Administration may be systemic or local. A dosage of about $1\text{-}10\times10^{14}$ vector genomes are contemplated for systemic administration. See also, e.g., Eulalio et al. (2012) Nature 492: 376 and Somasuntharam et al. (2013) Biomaterials 34: 7790.

For example, US Patent Publication No. 20110023139, describes use of zinc finger nucleases to genetically modify cells, animals and proteins associated with cardiovascular disease. Cardiovascular diseases generally include high blood pressure, heart attacks, heart failure, and stroke and TIA. Any chromosomal sequence involved in cardiovascular disease or the protein encoded by any chromosomal sequence involved in cardiovascular disease may be utilized in the methods described in this disclosure. The cardiovascular-related proteins are typically selected based on an experimental association of the cardiovascular-related protein to the development of cardiovascular disease. For example, the production rate or circulating concentration of a cardiovascular-related protein may be elevated or depressed in a population having a cardiovascular disorder relative to a population lacking the cardiovascular disorder. Differences in protein levels may be assessed using proteomic techniques including but not limited to Western blot, immunohistochemical staining, enzyme linked immunosorbent assay (ELISA), and mass spectrometry. Alternatively, the cardiovascular-related proteins may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of example, the chromosomal sequence may comprise, but is not limited to, IL1B (interleukin 1, beta), XDH (xanthine dehydrogenase), TP53 (tumor protein p53), PTGIS (prostaglandin 12 (prostacyclin) synthase), MB (myoglobin), IL4 (interleukin 4), ANGPT1 (angiopoietin 1), ABCG8 (ATP-binding cassette, sub-family G (WHITE), member 8), CTSK (cathepsin K), PTGIR (prostaglandin 12 (prostacyclin) receptor (IP)), KCNJ11 (potassium inwardly-rectifying channel, subfamily J, member 11), INS (insulin), CRP (C-reactive protein, pentraxin-related), PDGFRB (platelet-derived growth factor receptor, beta polypeptide), CCNA2 (cyclin A2), PDGFB (platelet-derived growth factor beta polypeptide (simian sarcoma viral (v-sis) oncogene homolog)), KCNJ5 (potassium inwardly-rectifying channel, subfamily J, member 5), KCNN3 (potassium intermediate/small conductance calcium-activated channel, subfamily N, member 3), CAPN10 (calpain 10), PTGES (prostaglandin E synthase), ADRA2B (adrenergic, alpha-2B-, receptor), ABCG5 (ATP-binding cassette, sub-family G (WHITE), member 5), PRDX2 (peroxiredoxin 2), CAPN5 (calpain 5), PARP14 (poly (ADP-ribose) polymerase family, member 14), MEX3C (mex-3 homolog C (C. elegans)), ACE angiotensin I converting enzyme (peptidyl-dipeptidase A) 1), TNF (tumor necrosis factor (TNF superfamily, member 2)), IL6 (interleukin 6 (interferon, beta 2)), STN (statin), SERPINE1 (serpin peptidase inhibitor, clade E (nexin, plasminogen activator inhibitor type 1), member 1), ALB (albumin), ADIPOQ (adiponectin, C1Q and collagen domain containing), APOB (apolipoprotein B (including Ag(x) antigen)), APOE (apolipoprotein E), LEP (leptin), MTHFR (5,10-methylenetetrahydrofolate reductase (NADPH)), APOA1 (apolipoprotein A-I), EDN1 (endothelin 1), NPPB (natriuretic peptide precursor B), NOS3 (nitric oxide synthase 3 (endothelial cell)), PPARG (peroxisome proliferator-activated receptor gamma), PLAT (plasminogen activator, tissue), PTGS2 (prostaglandin-endoperoxide synthase 2 (prostaglandin G/H synthase and cyclooxygenase)), CETP (cholesteryl ester transfer protein, plasma), AGTR1 (angiotensin II receptor, type 1), HMGCR (3-hydroxy-3-methylglutaryl-Coenzyme A reductase), IGF1 (insulin-like growth factor 1 (somatomedin C)), SELE (selectin E), REN (renin), PPARA (peroxisome proliferator-activated receptor alpha), PON1 (paraoxonase 1), KNG1 (kininogen 1), CCL2 (chemokine (C-C motif) ligand 2), LPL (lipoprotein lipase), VWF (von Willebrand factor), F2 (coagulation factor II (thrombin)), ICAM1 (intercellular adhesion molecule 1), TGFB1 (transforming growth factor, beta 1), NPPA (natriuretic peptide precursor A), IL10 (interleukin 10), EPO (erythropoietin), SOD1 (superoxide dismutase 1, soluble), VCAM1 (vascular cell adhesion molecule 1), IFNG (interferon, gamma), LPA (lipoprotein, Lp(a)), MPO (myeloperoxidase), ESR1 (estrogen receptor 1), MAPK1 (mitogen-activated protein kinase 1), HP (haptoglobin), F3 (coagulation factor III (thromboplastin, tissue factor)), CST3 (cystatin C), COG2 (component of oligomeric golgi complex 2), MMP9 (matrix metallopeptidase 9 (gelatinase B, 92 kDa gelatinase, 92 kDa type IV collagenase)), SERPINC1 (serpin peptidase inhibitor, clade C (antithrombin), member 1), F8 (coagulation factor VIII, procoagulant component), HMOX1 (heme oxygenase (decycling) 1), APOC3 (apolipoprotein C-III), IL8 (interleukin 8), PROK (prokineticin 1), CBS (cystathionine-beta-synthase), NOS2 (nitric oxide synthase 2, inducible), TLR4 (toll-like receptor 4), SELP (selectin P (granule membrane protein 140 kDa, antigen CD62)), ABCA1 (ATP-binding cassette, sub-family A (ABC1), member 1), AGT (angiotensinogen (serpin peptidase inhibitor, clade A, member 8)), LDLR (low density lipoprotein receptor), GPT (glutamic-pyruvate transaminase (alanine aminotransferase)), VEGFA (vascular endothelial growth factor A), NR3C2 (nuclear receptor subfamily 3, group C, member 2), IL18 (interleukin 18 (interferon-gamma-inducing factor)), NOS1 (nitric oxide synthase 1 (neuronal)), NR3C1 (nuclear receptor subfamily 3, group C, member 1 (glucocorticoid receptor)), FGB (fibrinogen beta chain), HGF (hepatocyte growth factor (hepapoietin A; scatter factor)), IL1A (interleukin 1, alpha), RETN (resistin), AKT1 (v-akt murine thymoma viral oncogene homolog 1), LIPC (lipase, hepatic), HSPD1 (heat shock 60 kDa protein 1 (chaperonin)), MAPK14 (mitogen-activated protein kinase 14), SPP1 (secreted phosphoprotein 1), ITGB3 (integrin, beta 3 (platelet glycoprotein 111a, antigen CD61)), CAT (catalase), UTS2 (urotensin 2), THBD (thrombomodulin), F10 (coagulation factor X), CP (ceruloplasmin (ferroxidase)), TNFRSF11B (tumor necrosis factor receptor superfamily, member 11b), EDNRA (endothelin receptor type A), EGFR (epidermal growth factor receptor (erythroblastic leukemia viral (v-erb-b) oncogene homolog, avian)), MMP2 (matrix metallopeptidase 2 (gelatinase A, 72 kDa gelatinase, 72 kDa type IV collagenase)), PLG (plasminogen), NPY (neuropeptide Y), RHOD (ras homolog gene family, member D), MAPK8 (mitogen-activated protein kinase 8), MYC (v-myc myelocytomatosis viral oncogene homolog (avian)), FN1 (fibronectin 1), CMA1 (chymase 1, mast cell), PLAU (plasminogen activator, urokinase), GNB3 (guanine nucleotide binding protein (G protein), beta polypeptide 3), ADRB2 (adrenergic, beta-2-, receptor, surface), APOA5 (apolipoprotein A-V), SOD2 (superoxide dismutase 2, mitochondrial), F5 (coagulation factor V (proaccelerin, labile factor)), VDR (vitamin D (1,25-dihydroxyvitamin D3) receptor), ALOX5 (arachidonate 5-lipoxygenase), HLA-DRB1 (major histocompatibility complex, class II, DR beta 1), PARP1 (poly (ADP-ribose) polymerase 1), CD40LG (CD40 ligand), PON2 (paraoxonase 2), AGER (advanced glycosylation end product-specific receptor), IRS1 (insulin receptor substrate 1), PTGS1 (prostaglandin-endoperoxide synthase 1 (prostaglandin G/H synthase and cyclooxygenase)), ECE1 (endothelin converting enzyme 1), F7 (coagulation factor VII (serum prothrombin conversion accelerator)), URN (interleukin 1 receptor antagonist), EPHX2 (epoxide hydrolase 2, cytoplasmic), IGFBP1 (insulin-like growth factor binding protein 1), MAPK10 (mitogen-activated protein kinase 10), FAS (Fas (TNF receptor superfamily, member 6)), ABCB1 (ATP-binding cassette, subfamily B (MDR/TAP), member 1), JUN (jun oncogene), IGFBP3 (insulin-like growth factor binding protein 3), CD14 (CD14 molecule), PDE5A (phosphodiesterase 5A, cGMP-specific), AGTR2 (angiotensin II receptor, type 2), CD40 (CD40 molecule, TNF receptor superfamily member 5), LCAT (lecithin-cholesterol acyltransferase), CCR5 (chemokine (C-C motif) receptor 5), MMP1 (matrix metallopeptidase 1 (interstitial collagenase)), TIMP1 (TIMP metallopeptidase inhibitor 1), ADM (adrenomedullin), DYT10 (dystonia 10), STAT3 (signal transducer and activator of transcription 3 (acute-phase response factor)), MMP3 (matrix metallopeptidase 3 (stromelysin 1, progelatinase)), ELN (elastin), USF1 (upstream transcription factor 1), CFH (complement factor H), HSPA4 (heat shock 70 kDa protein 4), MMP12 (matrix metallopeptidase 12 (macrophage elastase)), MME (membrane metallo-endopeptidase), F2R (coagulation factor II (thrombin) receptor), SELL (selectin L), CTSB (cathepsin B), ANXA5 (annexin A5), ADRB1 (adrenergic, beta-1-, receptor), CYBA (cytochrome b-245, alpha polypeptide), FGA (fibrinogen alpha chain), GGT1 (gamma-glutamyltransferase 1), LIPG (lipase, endothelial), HIF1A (hypoxia inducible factor 1, alpha subunit (basic helix-loop-helix transcription factor)), CXCR4 (chemokine (C-X-C motif) receptor 4), PROC (protein C (inactivator of coagulation factors Va and VIIIa)), SCARB1 (scavenger receptor class B, member 1), CD79A (CD79a molecule, immunoglobulin-associated alpha), PLTP (phospholipid transfer protein), ADD1 (adducin 1 (alpha)), FGG (fibrinogen gamma chain), SAA1 (serum amyloid A1), KCNH2 (potassium voltage-gated channel, subfamily H (eag-related), member 2), DPP4 (dipeptidyl-peptidase 4), G6PD (glucose-6-phosphate dehydrogenase), NPR1 (natriuretic peptide receptor A/guanylate cyclase A (atrionatriuretic peptide receptor A)), VTN (vitronectin), KIAA0101 (KIAA0101), FOS (FBJ murine osteosarcoma viral oncogene homolog), TLR2 (toll-like receptor 2), PPIG (peptidylprolyl isomerase G (cyclophilin G)), IL1R1 (interleukin 1 receptor, type I), AR (androgen receptor), CYP1A1 (cytochrome P450, family 1, subfamily A, polypeptide 1), SERPINA1 (serpin peptidase inhibitor, clade A (alpha-1 antiproteinase, antitrypsin), member 1), MTR (5-methyltetrahydrofolate-homocysteine methyltransferase), RBP4 (retinol binding protein 4, plasma), APOA4 (apolipoprotein A-IV), CDKN2A (cyclin-dependent kinase inhibitor 2A (melanoma, p16, inhibits CDK4)), FGF2 (fibroblast growth factor 2 (basic)), EDNRB (endothelin receptor type B), ITGA2 (integrin, alpha 2 (CD49B, alpha 2 subunit of VLA-2 receptor)), CABIN1 (calcineurin binding protein 1), SHBG (sex hormone-binding globulin), HMGB1 (high-mobility group box 1), HSP90B2P (heat shock protein 90 kDa beta (Grp94), member 2 (pseudogene)), CYP3A4 (cytochrome P450, family 3, subfamily A, polypeptide 4), GJA1 (gap junction protein, alpha 1, 43 kDa), CAV1 (caveolin 1, caveolae protein, 22 kDa), ESR2 (estrogen receptor 2 (ER beta)), LTA (lymphotoxin alpha (TNF superfamily, member 1)), GDF15 (growth differentiation factor 15), BDNF (brain-derived neurotrophic factor), CYP2D6 (cytochrome P450, family 2, subfamily D, polypeptide 6), NGF (nerve growth factor (beta polypeptide)), SP1 (Sp1 transcription factor), TGIF1 (TGFB-induced factor homeobox 1), SRC (v-src sarcoma (Schmidt-Ruppin A-2) viral oncogene homolog (avian)), EGF (epidermal growth factor (beta-urogastrone)), PIK3CG (phosphoinositide-3-kinase, catalytic, gamma polypeptide), HLA-A (major histocompatibility complex, class I, A), KCNQ1 (potassium voltage-gated channel, KQT-like subfamily, member 1), CNR1 (cannabinoid receptor 1 (brain)), FBN1 (fibrillin 1), CHKA (choline kinase alpha), BEST1 (bestrophin 1), APP (amyloid beta (A4) precursor protein), CTNNB1 (catenin (cadherin-associated protein), beta 1, 88 kDa), IL2 (interleukin 2), CD36 (CD36 molecule (thrombospondin receptor)), PRKAB1 (protein kinase, AMP-activated, beta 1 non-catalytic subunit), TPO (thyroid peroxidase), ALDH7A1 (aldehyde dehydrogenase 7 family, member A1), CX3CR1 (chemokine (C-X3-C motif) receptor 1), TH (tyrosine hydroxylase), F9 (coagulation factor IX), GH1 (growth hormone 1), TF (transferrin), HFE (hemochromatosis), IL17A (interleukin 17A), PTEN (phosphatase and tensin homolog), GSTM1 (glutathione S-transferase mu 1), DMD (dystrophin), GATA4 (GATA binding protein 4), F13A1 (coagulation factor XIII, A1 polypeptide), TTR (transthyretin), FABP4 (fatty acid binding protein 4, adipocyte), PON3 (paraoxonase 3), APOC1 (apolipoprotein C-I), INSR (insulin receptor), TNFRSF1B (tumor necrosis factor receptor superfamily, member 1B), HTR2A (5-hydroxytryptamine (serotonin) receptor 2A), CSF3 (colony stimulating factor 3 (granulocyte)), CYP2C9 (cytochrome P450, family 2, subfamily C, polypeptide 9), TXN (thioredoxin), CYP11B2 (cytochrome P450, family 11, subfamily B, polypeptide 2), PTH (parathyroid hormone), CSF2 (colony stimulating factor 2 (granulocyte-macrophage)), KDR (kinase insert domain receptor (a type III receptor tyrosine kinase)), PLA2G2A (phospholipase A2, group IIA (platelets, synovial fluid)), B2M (beta-2-microglobulin), THBS1 (thrombospondin 1), GCG (glucagon), RHOA (ras homolog gene family, member A), ALDH2 (aldehyde dehydrogenase 2 family (mitochondrial)), TCF7L2 (transcription factor 7-like 2 (T-cell specific, HMG-box)), BDKRB2 (bradykinin receptor B2), NFE2L2 (nuclear factor (erythroid-derived 2)-like 2), NOTCH1 (Notch homolog 1, translocation-associated (Drosophila)), UGT1A1 (UDP glucuronosyltransferase 1 family, polypeptide A1), IFNA1 (interferon, alpha 1), PPARD (peroxisome proliferator-activated receptor delta), SIRT1 (sirtuin (silent mating type information regulation 2 homolog) 1 (S. cerevisiae)), GNRH1 (gonadotropin-releasing hormone 1 (luteinizing-releasing hormone)), PAPPA (pregnancy-associated plasma protein A, pappalysin 1), ARR3 (arrestin 3, retinal (X-arrestin)), NPPC (natriuretic peptide precursor C), AHSP (alpha hemoglobin stabilizing protein), PTK2 (PTK2 protein tyrosine kinase 2), IL13 (interleukin 13), MTOR (mechanistic target of rapamycin (serine/threonine kinase)), ITGB2 (integrin, beta 2 (complement component 3 receptor 3 and 4 subunit)), GSTT1 (glutathione S-transferase theta 1), IL6ST (interleukin 6 signal transducer (gp130, oncostatin M receptor)), CPB2 (carboxypeptidase B2 (plasma)), CYP1A2 (cytochrome P450, family 1, subfamily A, polypeptide 2), HNF4A (hepatocyte nuclear factor 4, alpha), SLC6A4 (solute carrier family 6 (neurotransmitter transporter, serotonin), member 4), PLA2G6 (phospholipase A2, group VI (cytosolic, calcium-independent)), TNFSF11 (tumor necrosis factor (ligand) superfamily, member 11), SLC8A1 (solute carrier family 8 (sodium/calcium exchanger), member 1), F2RL1 (coagulation factor II (thrombin) receptor-like 1), AKR1A1 (aldo-keto reductase family 1, member A1 (aldehyde reductase)), ALDH9A1 (aldehyde dehydrogenase 9 family, member A1), BGLAP (bone gamma-carboxyglutamate (gla) protein), MTTP (microsomal triglyceride transfer protein), MTRR (5-methyltetrahydrofolate-homocysteine methyltransferase reductase), SULT1A3 (sulfotransferase family, cytosolic, 1A, phenol-preferring, member 3), RAGE (renal tumor antigen), C4B (complement component 4B (Chido blood group), P2RY12 (purinergic receptor P2Y, G-protein coupled, 12), RNLS (renalase, FAD-dependent amine oxidase), CREB1 (cAMP responsive element binding protein 1), POMC (proopiomelanocortin), RAC1 (ras-related C3 botulinum toxin substrate 1 (rho family, small GTP binding protein Rac1)), LMNA (lamin NC), CD59 (CD59 molecule, complement regulatory protein), SCN5A (sodium channel, voltage-gated, type V, alpha subunit), CYP1B1 (cytochrome P450, family 1, subfamily B, polypeptide 1), MIF (macrophage migration inhibitory factor (glycosylation-inhibiting factor)), MMP13 (matrix metallopeptidase 13 (collagenase 3)), TIMP2 (TIMP metallopeptidase inhibitor 2), CYP19A1 (cytochrome P450, family 19, subfamily A, polypeptide 1), CYP21A2 (cytochrome P450, family 21, subfamily A, polypeptide 2), PTPN22 (protein tyrosine phosphatase, non-receptor type 22 (lymphoid)), MYH14 (myosin, heavy chain 14, non-muscle), MBL2 (mannose-binding lectin (protein C) 2, soluble (opsonic defect)), SELPLG (selectin P ligand), AOC3 (amine oxidase, copper containing 3 (vascular adhesion protein 1)), CTSL1 (cathepsin Li), PCNA (proliferating cell nuclear antigen), IGF2 (insulin-like growth factor 2 (somatomedin A)), ITGB1 (integrin, beta 1 (fibronectin receptor, beta polypeptide, antigen CD29 includes MDF2, MSK12)), CAST (calpastatin), CXCL12 (chemokine (C-X-C motif) ligand 12 (stromal cell-derived factor 1)), IGHE (immunoglobulin heavy constant epsilon), KCNE1 (potassium voltage-gated channel, Isk-related family, member 1), TFRC (transferrin receptor (p90, CD71)), COL1A1 (collagen, type I, alpha 1), COL1A2 (collagen, type I, alpha 2), IL2RB (interleukin 2 receptor, beta), PLA2G10 (phospholipase A2, group X), ANGPT2 (angiopoietin 2), PROCR (protein C receptor, endothelial (EPCR)), NOX4 (NADPH oxidase 4), HAMP (hepcidin antimicrobial peptide), PTPN11 (protein tyrosine phosphatase, non-receptor type 11), SLC2A1 (solute carrier family 2 (facilitated glucose transporter), member 1), IL2RA (interleukin 2 receptor, alpha), CCL5 (chemokine (C-C motif) ligand 5), IRF1 (interferon regulatory factor 1), CFLAR (CASP8 and FADD-like apoptosis regulator), CALCA (calcitonin-related polypeptide alpha), EIF4E (eukaryotic translation initiation factor 4E), GSTP1 (glutathione S-transferase pi 1), JAK2 (Janus kinase 2), CYP3A5 (cytochrome P450, family 3, subfamily A, polypeptide 5), HSPG2 (heparan sulfate proteoglycan 2), CCL3 (chemokine (C-C motif) ligand 3), MYD88 (myeloid differentiation primary response gene (88)), VIP (vasoactive intestinal peptide), SOAT1 (sterol O-acyltransferase 1), ADRBK1 (adrenergic, beta, receptor kinase 1), NR4A2 (nuclear receptor subfamily 4, group A, member 2), MMP8 (matrix metallopeptidase 8 (neutrophil collagenase)), NPR2 (natriuretic peptide receptor B/guanylate cyclase B (atrionatriuretic peptide receptor B)), GCH1 (GTP cyclohydrolase 1), EPRS (glutamyl-prolyl-tRNA synthetase), PPARGC1A (peroxisome proliferator-activated receptor gamma, coactivator 1 alpha), F12 (coagulation factor XII (Hageman factor)), PECAM1 (platelet/endothelial cell adhesion molecule), CCL4 (chemokine (C-C motif) ligand 4), SERPINA3 (serpin peptidase inhibitor, clade A (alpha-1 antiproteinase, antitrypsin), member 3), CASR (calcium-sensing receptor), GJA5 (gap junction protein, alpha 5, 40 kDa), FABP2 (fatty acid binding protein 2, intestinal), TTF2 (transcription termination factor, RNA polymerase II), PROS1 (protein S (alpha)), CTF1 (cardiotrophin 1), SGCB (sarcoglycan, beta (43 kDa dystrophin-associated glycoprotein)), YME1L1 (YME1-like 1 (*S. cerevisiae*)), CAMP (cathelicidin antimicrobial peptide), ZC3H12A (zinc finger CCCH-type containing 12A), AKR1B1 (aldo-keto reductase family 1, member B1 (aldose reductase)), DES (desmin), MMP7 (matrix metallopeptidase 7 (matrilysin, uterine)), AHR (aryl hydrocarbon receptor), CSF1 (colony stimulating factor 1 (macrophage)), HDAC9 (histone deacetylase 9), CTGF (connective tissue growth factor), KCNMA1 (potassium large conductance calcium-activated channel, subfamily M, alpha member 1), UGT1A (UDP glucuronosyltransferase 1 family, polypeptide A complex locus), PRKCA (protein kinase C, alpha), COMT (catechol-.beta.-methyltransferase), S100B (S100 calcium binding protein B), EGR1 (early growth response 1), PRL (prolactin), IL15 (interleukin 15), DRD4 (dopamine receptor D4), CAMK2G (calcium/calmodulin-dependent protein kinase II gamma), SLC22A2 (solute carrier family 22 (organic cation transporter), member 2), CCL11 (chemokine (C-C motif) ligand 11), PGF (B321 placental growth factor), THPO (thrombopoietin), GP6 (glycoprotein VI (platelet)), TACR1 (tachykinin receptor 1), NTS (neurotensin), HNF1A (HNF1 homeobox A), SST (somatostatin), KCND1 (potassium voltage-gated channel, Shal-related subfamily, member 1), LOC646627 (phospholipase inhibitor), TBXAS1 (thromboxane A synthase 1 (platelet)), CYP2J2 (cytochrome P450, family 2, subfamily J, polypeptide 2), TBXA2R (thromboxane A2 receptor), ADH1C (alcohol dehydrogenase 1C (class I), gamma polypeptide), ALOX12 (arachidonate 12-lipoxygenase), AHSG (alpha-2-HS-glycoprotein), BHMT (betaine-homocysteine methyltransferase), GJA4 (gap junction protein, alpha 4, 37 kDa), SLC25A4 (solute carrier family 25 (mitochondrial carrier; adenine nucleotide translocator), member 4), ACLY (ATP citrate lyase), ALOX5AP (arachidonate 5-lipoxygenase-activating protein), NUMA1 (nuclear mitotic apparatus protein 1), CYP27B1 (cytochrome P450, family 27, subfamily B, polypeptide 1), CYSLTR2 (cysteinyl leukotriene receptor 2), SOD3 (superoxide dismutase 3, extracellular), LTC4S (leukotriene C4 synthase), UCN (urocortin), GHRL (ghrelin/obestatin prepropeptide), APOC2 (apolipoprotein C-II), CLEC4A (C-type lectin domain family 4, member A), KBTBD10 (kelch repeat and BTB (POZ) domain containing 10), TNC (tenascin C), TYMS (thymidylate synthetase), SHC1 (SHC (Src homology 2 domain containing) transforming protein 1), LRP1 (low density lipoprotein receptor-related protein 1), SOCS3 (suppressor of cytokine signaling 3), ADH1B (alcohol dehydrogenase 1B (class I), beta polypeptide), KLK3 (kallikrein-related peptidase 3), HSD11B1 (hydroxysteroid (11-beta) dehydrogenase 1), VKORC1 (vitamin K epoxide reductase complex, subunit 1), SERPINB2 (serpin peptidase inhibitor, clade B (ovalbumin), member 2), TNS1 (tensin 1), RNF19A (ring finger protein 19A), EPOR (erythropoietin receptor), ITGAM (integrin, alpha M (complement component 3 receptor 3 subunit)), PITX2 (paired-like homeodomain 2), MAPK7 (mitogen-activated protein kinase 7), FCGR3A (Fc fragment of IgG, low affinity 111a, receptor (CD16a)), LEPR (leptin receptor), ENG (endoglin), GPX1 (glutathione peroxidase 1), GOT2 (glutamic-oxaloacetic transaminase 2, mitochondrial (aspartate aminotransferase 2)), HRH1 (histamine receptor H1), NR1I2 (nuclear receptor subfamily 1, group I, member 2), CRH (corticotropin releasing hormone), HTR1A (5-hydroxytryptamine (serotonin) receptor 1A), VDAC1 (voltage-dependent anion channel 1), HPSE (heparanase), SFTPD (surfactant protein D), TAP2 (transporter 2, ATP-binding cassette, sub-family B (MDR/TAP)), RNF123 (ring finger protein 123), PTK2B (PTK2B protein tyrosine kinase 2 beta), NTRK2 (neurotrophic tyrosine kinase, receptor, type 2), IL6R (interleukin 6 receptor), ACHE (acetylcholinesterase (Yt blood group)), GLP1R (glucagon-like peptide 1 receptor), GHR (growth hormone receptor), GSR (glutathione reductase), NQO1 (NAD(P)H dehydrogenase, quinone 1), NR5A1 (nuclear receptor subfamily 5, group A, member 1), GJB2 (gap junction protein, beta 2, 26 kDa), SLC9A1 (solute carrier family 9 (sodium/hydrogen exchanger), member 1), MAOA (monoamine oxidase A), PCSK9 (proprotein convertase subtilisin/kexin type 9), FCGR2A (Fc fragment of IgG, low affinity IIa, receptor (CD32)), SERPINF1 (serpin peptidase inhibitor, clade F (alpha-2 antiplasmin, pigment epithelium derived factor), member 1), EDN3 (endothelin 3), DHFR (dihydrofolate reductase), GAS6 (growth arrest-specific 6), SMPD1 (sphingomyelin phosphodiesterase 1, acid lysosomal), UCP2 (uncoupling protein 2 (mitochondrial, proton carrier)), TFAP2A (transcription factor AP-2 alpha (activating enhancer binding protein 2 alpha)), C4BPA (complement component 4 binding protein, alpha), SERPINF2 (serpin peptidase inhibitor, clade F (alpha-2 antiplasmin, pigment epithelium derived factor), member 2), TYMP (thymidine phosphorylase), ALPP (alkaline phosphatase, placental (Regan isozyme)), CXCR2 (chemokine (C-X-C motif) receptor 2), SLC39A3 (solute carrier family 39 (zinc transporter), member 3), ABCG2 (ATP-binding cassette, sub-family G (WHITE), member 2), ADA (adenosine deaminase), JAK3 (Janus kinase 3), HSPA1A (heat shock 70 kDa protein 1A), FASN (fatty acid synthase), FGF1 (fibroblast growth factor 1 (acidic)), F11 (coagulation factor XI), ATP7A (ATPase, Cu++ transporting, alpha polypeptide), CR1 (complement component (3b/4b) receptor 1 (Knops blood group)), GFAP (glial fibrillary acidic protein), ROCK1 (Rho-associated, coiled-coil containing protein kinase 1), MECP2 (methyl CpG binding protein 2 (Rett syndrome)), MYLK (myosin light chain kinase), BCHE (butyrylcholinesterase), LIPE (lipase, hormone-sensitive), PRDX5 (peroxiredoxin 5), ADORA1 (adenosine A1 receptor), WRN (Werner syndrome, RecQ helicase-like), CXCR3 (chemokine (C-X-C motif) receptor 3), CD81 (CD81 molecule), SMAD7 (SMAD family member 7), LAMC2 (laminin, gamma 2), MAP3K5 (mitogen-activated protein kinase kinase kinase 5), CHGA (chromogranin A (parathyroid secretory protein 1)), IAPP (islet amyloid polypeptide), RHO (rhodopsin), ENPP1 (ectonucleotide pyrophosphatase/phosphodiesterase 1), PTHLH (parathyroid hormone-like hormone), NRG1 (neuregulin 1), VEGFC (vascular endothelial growth factor C), ENPEP (glutamyl aminopeptidase (aminopeptidase A)), CEBPB (CCAAT/enhancer binding protein (C/EBP), beta), NAGLU (N-acetylglucosaminidase, alpha-), F2RL3 (coagulation factor II (thrombin) receptor-like 3), CX3CL1 (chemokine (C-X3-C motif) ligand 1), BDKRB1 (bradykinin receptor B1), ADAMTS13 (ADAM metallopeptidase with thrombospondin type 1 motif, 13), ELANE (elastase, neutrophil expressed), ENPP2 (ectonucleotide pyrophosphatase/phosphodiesterase 2), CISH (cytokine inducible SH2-containing protein), GAST (gastrin), MYOC (myocilin, trabecular meshwork inducible glucocorticoid response), ATP1A2 (ATPase, Na+/K+ transporting, alpha 2 polypeptide), NF1 (neurofibromin 1), GJB1 (gap junction protein, beta 1, 32 kDa), MEF2A (myocyte enhancer factor 2A), VCL (vinculin), BMPR2 (bone morphogenetic protein receptor, type II (serine/threonine kinase)), TUBB (tubulin, beta), CDC42 (cell division cycle 42 (GTP binding protein, 25 kDa)), KRT18 (keratin 18), HSF1 (heat shock transcription factor 1), MYB (v-myb myeloblastosis viral oncogene homolog (avian)), PRKAA2 (protein kinase, AMP-activated, alpha 2 catalytic subunit), ROCK2 (Rho-associated, coiled-coil containing protein kinase 2), TFPI (tissue factor pathway inhibitor (lipoprotein-associated coagulation inhibitor)), PRKG1 (protein kinase, cGMP-dependent, type I), BMP2 (bone morphogenetic protein 2), CTNND1 (catenin (cadherin-associated protein), delta 1), CTH (cystathionase (cystathionine gamma-lyase)), CTSS (cathepsin S), VAV2 (vav 2 guanine nucleotide exchange factor), NPY2R (neuropeptide Y receptor Y2), IGFBP2 (insulin-like growth factor binding protein 2, 36 kDa), CD28 (CD28 molecule), GSTA1 (glutathione S-transferase alpha 1), PPIA (peptidylprolyl isomerase A (cyclophilin A)), APOH (apolipoprotein H (beta-2-glycoprotein I)), S100A8 (S100 calcium binding protein A8), IL11 (interleukin 11), ALOX15 (arachidonate 15-lipoxygenase), FBLN1 (fibulin 1), NR1H3 (nuclear receptor subfamily 1, group H, member 3), SCD (stearoyl-CoA desaturase (delta-9-desaturase)), GIP (gastric inhibitory polypeptide), CHGB (chromogranin B (secretogranin 1)), PRKCB (protein kinase C, beta), SRD5A1 (steroid-5-alpha-reductase, alpha polypeptide 1 (3-oxo-5 alpha-steroid delta 4-dehydrogenase alpha 1)), HSD11B2 (hydroxysteroid (11-beta) dehydrogenase 2), CALCRL (calcitonin receptor-like), GALNT2 (UDP-N-acetyl-alpha-D-galactosamine:polypeptide N-acetylgalactosaminyltransferase 2 (GalNAc-T2)), ANGPTL4 (angiopoietin-like 4), KCNN4 (potassium intermediate/small conductance calcium-activated channel, subfamily N, member 4), PIK3C2A (phosphoinositide-3-kinase, class 2, alpha polypeptide), HBEGF (heparin-binding EGF-like growth factor), CYP7A1 (cytochrome P450, family 7, subfamily A, polypeptide 1), HLA-DRB5 (major histocompatibility complex, class II, DR beta 5), BNIP3 (BCL2/adenovirus E1B 19 kDa interacting protein 3), GCKR (glucokinase (hexokinase 4) regulator), S100A12 (S100 calcium binding protein A12), PADI4 (peptidyl arginine deiminase, type IV), HSPA14 (heat shock 70 kDa protein 14), CXCR1 (chemokine (C-X-C motif) receptor 1), H19 (H19, imprinted maternally expressed transcript (non-protein coding)), KRTAP19-3 (keratin associated protein 19-3), IDDM2 (insulin-dependent diabetes mellitus 2), RAC2 (ras-related C3 botulinum toxin substrate 2 (rho family, small GTP binding protein Rac2)), RYR1 (ryanodine receptor 1 (skeletal)), CLOCK (clock homolog (mouse)), NGFR (nerve growth factor receptor (TNFR superfamily, member 16)), DBH (dopamine beta-hydroxylase (dopamine beta-monooxygenase)), CHRNA4 (cholinergic receptor, nicotinic, alpha 4), CACNA1C (calcium channel, voltage-dependent, L type, alpha 1C subunit), PRKAG2 (protein kinase, AMP-activated, gamma 2 non-catalytic subunit), CHAT (choline acetyltransferase), PTGDS (prostaglandin D2 synthase 21 kDa (brain)), NR1H2 (nuclear receptor subfamily 1, group H, member 2), TEK (TEK tyrosine kinase, endothelial), VEGFB (vascular endothelial growth factor B), MEF2C (myocyte enhancer factor 2C), MAPKAPK2 (mitogen-activated protein kinase-activated protein kinase 2), TNFRSF11A (tumor necrosis factor receptor superfamily, member 11a, NFKB activator), HSPA9 (heat shock 70 kDa protein 9 (mortalin)), CYSLTR1 (cysteinyl leukotriene receptor 1), MAT1A (methionine adenosyltransferase I, alpha), OPRL1 (opiate receptor-like 1), IMPA1 (inositol (myo)-1(or 4)-monophosphatase 1), CLCN2 (chloride channel 2), DLD (dihydrolipoamide dehydrogenase), PSMA6 (proteasome (prosome, macropain) subunit, alpha type, 6), PSMB8 (proteasome (prosome, macropain) subunit, beta type, 8 (large multifunctional peptidase 7)), CHI3L1 (chitinase 3-like 1 (cartilage glycoprotein-39)), ALDH1B1 (aldehyde dehydrogenase 1 family, member B1), PARP2 (poly (ADP-ribose) polymerase 2), STAR (steroidogenic acute regulatory protein), LBP (lipopolysaccharide binding protein), ABCC6 (ATP-binding cassette, sub-family C(CFTR/MRP), member 6), RGS2 (regulator of G-protein signaling 2, 24 kDa), EFNB2 (ephrin-B2), GJB6 (gap junction protein, beta 6, 30 kDa), APOA2 (apolipoprotein A-II), AMPD1 (adenosine monophosphate deaminase 1), DYSF (dysferlin, limb girdle muscular dystrophy 2B (autosomal recessive)), FDFT1 (farnesyl-diphosphate farnesyltransferase 1), EDN2 (endothelin 2), CCR6 (chemokine (C-C motif) receptor 6), GJB3 (gap junction protein, beta 3, 31 kDa), IL1RL1 (interleukin I receptor-like 1), ENTPD1 (ectonucleoside triphosphate diphosphohydrolase 1), BBS4 (Bardet-Biedl syndrome 4), CELSR2 (cadherin, EGF LAG seven-pass G-type receptor 2 (flamingo homolog, *Drosophila*)), F11R (F11 receptor), RAPGEF3 (Rap guanine nucleotide exchange factor (GEF) 3), HYAL1 (hyaluronoglucosaminidase 1), ZNF259 (zinc finger protein 259), ATOX1 (ATX1 antioxidant protein 1 homolog (yeast)), ATF6 (activating transcription factor 6), KHK (ketohexokinase (fructokinase)), SAT1 (spermidine/spermine N1-acetyltransferase 1), GGH (gamma-glutamyl hydrolase (conjugase, folylpolygammaglutamyl hydrolase)), TIMP4 (TIMP metallopeptidase inhibitor 4), SLC4A4 (solute carrier family 4, sodium bicarbonate cotransporter, member 4), PDE2A (phosphodiesterase 2A, cGMP-stimulated), PDE3B (phosphodiesterase 3B, cGMP-inhibited), FADS1 (fatty acid desaturase 1), FADS2 (fatty acid desaturase 2), TMSB4X (thymosin beta 4, X-linked), TXNIP (thioredoxin interacting protein), LIMS1 (LIM and senescent cell antigen-like domains 1), RHOB (ras homolog gene family, member B), LY96 (lymphocyte antigen 96), FOXO1 (forkhead box 01), PNPLA2 (patatin-like phospholipase domain containing 2), TRH (thyrotropin-releasing hormone), GJC1 (gap junction protein, gamma 1, 45 kDa), SLC17A5 (solute carrier family 17 (anion/sugar transporter), member 5), FTO (fat mass and obesity associated), GJD2 (gap junction protein, delta 2, 36 kDa), PSRC1 (proline/serine-rich coiled-coil 1), CASP12 (caspase 12 (gene/pseudogene)), GPBAR1 (G protein-coupled bile acid receptor 1), PXK (PX domain containing serine/threonine kinase), IL33 (interleukin 33), TRIB1 (tribbles homolog 1 (*Drosophila*)), PBX4 (pre-B-cell leukemia homeobox 4), NUPR1 (nuclear protein, transcriptional regulator, 1), 15-Sep(15 kDa selenoprotein), CILP2 (cartilage intermediate layer protein 2), TERC (telomerase RNA component), GGT2 (gamma-glutamyltransferase 2), MT-CO1 (mitochondrially encoded cytochrome c oxidase I), and UOX (urate oxidase, pseudogene). Any of these sequences, may be a target for the CRISPR-Cas system, e.g., to address mutation. In an additional embodiment, the chromosomal sequence may further be selected from Pon1 (paraoxonase 1), LDLR (LDL receptor), ApoE (Apolipoprotein E), Apo B-100 (Apolipoprotein B-100), ApoA (Apolipoprotein(a)), ApoA1 (Apolipoprotein A1), CBS (Cystathione B-synthase), Glycoprotein IIb/IIb, MTHRF (5,10-methylenetetrahydrofolate reductase (NADPH), and combinations thereof. In one iteration, the chromosomal sequences and proteins encoded by chromosomal sequences involved in cardiovascular disease may be chosen from Cacna1C, Sod1, Pten, Ppar(alpha), Apo E, Leptin, and combinations thereof as target(s) for the CRISPR-Cas system.

Treating Diseases of the Liver and Kidney

The present invention also contemplates delivering the CRISPR-Cas system described herein, e.g. Cpf1 effector protein systems, to the liver and/or kidney. Delivery strategies to induce cellular uptake of the therapeutic nucleic acid include physical force or vector systems such as viral-, lipid- or complex-based delivery, or nanocarriers. From the initial applications with less possible clinical relevance, when nucleic acids were addressed to renal cells with hydrodynamic high pressure injection systemically, a wide range of gene therapeutic viral and non-viral carriers have been applied already to target posttranscriptional events in different animal kidney disease models in vivo (Csaba Révész and Péter Hamar (2011). Delivery Methods to Target RNAs in the Kidney, Gene Therapy Applications, Prof. Chunsheng Kang (Ed.), ISBN: 978-953-307-541-9, InTech, Available from: worldwideweb.intechopen.com/books/gene-therapy-applications/delivery-methods-to-target-rnas-inthe-kidney). Delivery methods to the kidney may include those in Yuan et al. (Am J Physiol Renal Physiol 295: F605-F617, 2008) investigated whether in vivo delivery of small interfering RNAs (siRNAs) targeting the 12/15-lipoxygenase (12/15-LO) pathway of arachidonate acid metabolism can ameliorate renal injury and diabetic nephropathy (DN) in a streptozotocininjected mouse model of type 1 diabetes. To achieve greater in vivo access and siRNA expression in the kidney, Yuan et al. used double-stranded 12/15-LO siRNA oligonucleotides conjugated with cholesterol. About 400 µg of siRNA was injected subcutaneously into mice. The method of Yuang et al. may be applied to the CRISPR Cas system of the present invention contemplating a 1-2 g subcutaneous injection of CRISPR Cas conjugated with cholesterol to a human for delivery to the kidneys.

Molitoris et al. (J Am Soc Nephrol 20: 1754-1764, 2009) exploited proximal tubule cells (PTCs), as the site of oligonucleotide reabsorption within the kidney to test the efficacy of siRNA targeted to p53, a pivotal protein in the apoptotic pathway, to prevent kidney injury. Naked synthetic siRNA to p53 injected intravenously 4 h after ischemic injury maximally protected both PTCs and kidney function. Molitoris et al.'s data indicates that rapid delivery of siRNA to proximal tubule cells follows intravenous administration. For dose-response analysis, rats were injected with doses of siP53, 0.33; 1, 3, or 5 mg/kg, given at the same four time points, resulting in cumulative doses of 1.32; 4, 12, and 20 mg/kg, respectively. All siRNA doses tested produced a SCr reducing effect on day one with higher doses being effective over approximately five days compared with PBS-treated ischemic control rats. The 12 and 20 mg/kg cumulative doses provided the best protective effect. The method of Molitoris et al. may be applied to the nucleic acid-targeting system of the present invention contemplating 12 and 20 mg/kg cumulative doses to a human for delivery to the kidneys.

Thompson et al. (Nucleic Acid Therapeutics, Volume 22, Number 4, 2012) reports the toxicological and pharmacokinetic properties of the synthetic, small interfering RNA I5NP following intravenous administration in rodents and nonhuman primates. I5NP is designed to act via the RNA interference (RNAi) pathway to temporarily inhibit expression of the pro-apoptotic protein p53 and is being developed to protect cells from acute ischemia/reperfusion injuries such as acute kidney injury that can occur during major cardiac surgery and delayed graft function that can occur following renal transplantation. Doses of 800 mg/kg I5NP in rodents, and 1,000 mg/kg I5NP in nonhuman primates, were required to elicit adverse effects, which in the monkey were isolated to direct effects on the blood that included a sub-clinical activation of complement and slightly increased clotting times. In the rat, no additional adverse effects were observed with a rat analogue of I5NP, indicating that the effects likely represent class effects of synthetic RNA duplexes rather than toxicity related to the intended pharmacologic activity of I5NP. Taken together, these data support clinical testing of intravenous administration of I5NP for the preservation of renal function following acute ischemia/reperfusion injury. The no observed adverse effect level (NOAEL) in the monkey was 500 mg/kg. No effects on cardiovascular, respiratory, and neurologic parameters were observed in monkeys following i.v. administration at dose levels up to 25 mg/kg. Therefore, a similar dosage may be contemplated for intravenous administration of CRISPR Cas to the kidneys of a human.

Shimizu et al. (J Am Soc Nephrol 21: 622-633, 2010) developed a system to target delivery of siRNAs to glomeruli via poly(ethylene glycol)-poly(L-lysine)-based vehicles. The siRNA/nanocarrier complex was approximately 10 to 20 nm in diameter, a size that would allow it to move across the fenestrated endothelium to access to the mesangium. After intraperitoneal injection of fluorescence-labeled siRNA/nanocarrier complexes, Shimizu et al. detected siRNAs in the blood circulation for a prolonged time. Repeated intraperitoneal administration of a mitogen-activated protein kinase 1 (MAPK1) siRNA/nanocarrier complex suppressed glomerular MAPK1 mRNA and protein expression in a mouse model of glomerulonephritis. For the investigation of siRNA accumulation, Cy5-labeled siRNAs complexed with PIC nanocarriers (0.5 ml, 5 nmol of siRNA content), naked Cy5-labeled siRNAs (0.5 ml, 5 nmol), or Cy5-labeled siRNAs encapsulated in HVJ-E (0.5 ml, 5 nmol of siRNA content) were administered to BALBc mice. The method of Shimizu et al. may be applied to the nucleic acid-targeting system of the present invention contemplating a dose of about of 10-20 μmol CRISPR Cas complexed with nanocarriers in about 1-2 liters to a human for intraperitoneal administration and delivery to the kidneys.

Delivery methods to the kidney are summarized as follows:

| Delivery method | Carrier | Target RNA | Disease | Model | Functional assays | Author |
| --- | --- | --- | --- | --- | --- | --- |
| Hydrodynamic/ Lipid | TransIT In Vivo Gene Delivery System, DOTAP | p85α | Acute renal injury | Ischemia-reperfusion | Uptake, biodistribution | Larson et al., Surgery, (August 2007), Vol. 142, No. 2, pp. (262-269) |
| Hydrodynamic/ Lipid | Lipofect-amine2000 | Fas | Acute renal injury | Ischemia-reperfusion | Blood urea nitrogen, Fas Immunohisto-chemistry, apoptosis, histological scoring | Hamar et al., Proc Natl Acad Sci, (October 2004), Vol. 101, No. 41, pp. (14883-14888) |
| Hydrodynamic | n.a. | Apoptosis cascade elements | Acute renal injury | Ischemia-reperfusion | n.a. | Zheng et al., Am J Pathol, (October 2008), Vol. 173, No. 4, pp. (973-980) |
| Hydrodynamic | n.a. | Nuclear factor kappa-b (NFkB) | Acute renal injury | Ischemia-reperfusion | n.a. | Feng et al., Transplantation, (May 2009), Vol. 87, No. 9, pp. (1283-1289) |
| Hydrodynamic/ Viral | Lipofect-amine2000 | Apoptosis antagonizing transcription factor (AATF) | Acute renal injury | Ischemia-reperfusion | Apoptosis, oxidative stress, caspase activation, membrane lipid peroxidation | Xie & Guo, Am Soc Nephrol, (December 2006), Vol. 17, No. 12, pp. (3336-3346) |
| Hydrodynamic | pBAsi mU6 Neo/TransIT-EE Hydrodynamic Delivery System | Gremlin | Diabetic nephropathy | Streptozotozin-induced diabetes | Proteinuria, serum creatinine, glomerular and tubular diameter, collagen type IV/BMP7 expression | Q. Zhang et al., PloS ONE, (July 2010), Vol. 5, No. 7, e11709, pp. (1-13) |

| Delivery method | Carrier | Target RNA | Disease | Model | Functional assays | Author |
|---|---|---|---|---|---|---|
| Viral/Lipid | pSUPER vector/Lipofect-amine | TGF-β type II receptor | Interstitial renal fibrosis | Unilateral urethral obstruction | α-SMA expression, collagen content, | Kushibikia et al., J Controlled Release, (July 2005), Vol. 105, No. 3, pp. (318-331) |
| Viral | Adeno-associated virus-2 | Mineral corticoid receptor | Hypertension caused renal damage | Cold-induced hypertension | blood pressure, serum albumin, serum urea nitrogen, serum creatinine, kidney weight, urinary sodium uptake | Wang et al., Gene Therapy, (July 2006), Vol. 13, No. 14, pp. (1097-1103) |
| Hydrodynamic/Viral | pU6 vector | Luciferase | n.a. | n.a. | | Kobayashi et al., Journal of Pharmacology and Experimental Therapeutics, (February 2004), Vol. 308, No. 2, pp. (688-693) |
| Lipid | Lipoproteins, albumin | apoB1, apoM | n.a. | n.a. | Uptake, binding affinity to lipoproteins and albumin | Wolfrum et al., Nature Biotechnology, (September 2007), Vol. 25, No. 10, pp. (1149-1157) |
| Lipid | Lipofect-amine2000 | p53 | Acute renal injury | Ischemic and cisplatin-induced acute injury | Histological scoring, apoptosis | Molitoris et al., J Am Soc Nephrol, (August 2009), Vol. 20, No. 8, pp. (1754-1764) |
| Lipid | DOTAP/DOPE, DOTAP/DOPE/DOPE-PEG2000 | COX-2 | Breast adeno-carcinoma | MDA-MB-231 breast cancer xenograft-bearing mouse | Cell viability, uptake | Mikhaylova et al., Cancer Gene Therapy, (March 2011), Vol. 16, No. 3, pp. (217-226) |
| Lipid | Cholesterol | 12/15-lipoxygenase | Diabetic nephropathy | Streptozotocin-induced diabetes | Albuminuria, urinary creatinine, histology, type I and IV collagen, TGF-β, fibronectin, plasminogen activator inhibitor 1 | Yuan et al., Am J Physiol Renal Physiol, (June 2008), Vol. 295, pp. (F605-F617) |
| Lipid | Lipofect-amine2000 | Mitochondrial membrane 44 (TIM44) | Diabetic nephropathy | Streptozotocin-induced diabetes | Cell proliferation and apoptosis, histology, ROS, mitochondrial import of Mn-SOD and glutathione peroxidase, cellular membrane polarization | Y. Zhang et al., J Am Soc Nephrol, (April 2006), Vol. 17, No. 4, pp. (1090-1101) |
| Hydrodynamic/Lipid | Proteolipo-some | RLIP76 | Renal carcinoma | Caki-2 kidney cancer xenograft-bearing mouse | uptake | Singhal et al., Cancer Res, (May 2009), Vol. 69, No. 10, pp. (4244-4251) |
| Polymer | PEGylated PEI | Luciferase pGL3 | n.a. | n.a. | Uptake, biodistribution, erythrocyte aggregation | Malek et al., Toxicology and Applied Pharmacology, (April 2009), Vol. 236, No. 1, pp. (97-108) |

| Delivery method | Carrier | Target RNA | Disease | Model | Functional assays | Author |
| --- | --- | --- | --- | --- | --- | --- |
| Polymer | PEGylated poly-L-lysine | MAPK1 | Lupus glomerulo-nephritis | Glomerulo-nephritis | Proteinuria, glomerulo-sclerosis, TGF-β, fibronectin, plasminogen activator inhibitor 1 | Shimizu et al., J Am Soc Nephrology, (April 2010), Vol. 21, No. 4, pp. (622-633) |
| Polymer/ Nano particle | Hyaluronic acid/Quantum dot/PEI | VEGF | Kidney cancer/melanoma | B16F1 melanoma tumor-bearing mouse | Biodistribution, citotoxicity, tumor volume, endocytosis | Jiang et al., Molecular Pharmaceutics, (May-June 2009), Vol. 6, No. 3, pp. (727-737) |
| Polymer/ Nano particle | PEGylated polycapro-lactone nanofiber | GAPDH | n.a. | n.a. | cell viability, uptake | Cao et al, J Controlled Release, (June 2010), Vol. 144, No. 2, pp. (203-212) |
| Aptamer | Spiegelmer mNOX-E36 | CC chemokine ligand 2 | Glomerulo sclerosis | Uninephrecto-mized mouse | urinary albumin, urinary creatinine, histopathology, glomerular filtration rate, macrophage count, serum Ccl2, Mac-2+, Ki-67+ | Ninichuk et al., Am J Pathol, (March 2008), Vol. 172, No. 3, pp. (628-637) |
| Aptamer | Aptamer NOX-F37 | vasopressin (AVP) | Congestive heart failure | n.a. | Binding affinity to D-AVP, Inhibition of AVP Signaling, Urine osmolality and sodium concentration, | Purschke et al., Proc Natl Acad Sci, (March 2006), Vol. 103, No. 13, pp. (5173-5178) |

Targeting the Liver or Liver Cells

Targeting liver cells is provided. This may be in vitro or in vivo. Hepatocytes are preferred. Delivery of the CRISPR protein, such as Cpf1 herein may be via viral vectors, especially AAV (and in particular AAV2/6) vectors. These may be administered by intravenous injection.

A preferred target for liver, whether in vitro or in vivo, is the albumin gene. This is a so-called 'safe harbor" as albumin is expressed at very high levels and so some reduction in the production of albumin following successful gene editing is tolerated. It is also preferred as the high levels of expression seen from the albumin promoter/enhancer allows for useful levels of correct or transgene production (from the inserted donor template) to be achieved even if only a small fraction of hepatocytes are edited.

Intron 1 of albumin has been shown by Wechsler et al. (reported at the 57th Annual Meeting and Exposition of the American Society of Hematology—abstract available online at ash.confex.com/ash/2015/webprogram/Paper86495.html and presented on 6 Dec. 2015) to be a suitable target site. Their work used Zn Fingers to cut the DNA at this target site, and suitable guide sequences can be generated to guide cleavage at the same site by a CRISPR protein.

The use of targets within highly-expressed genes (genes with highly active enhancers/promoters) such as albumin may also allow a promoterless donor template to be used, as reported by Wechsler et al. and this is also broadly applicable outside liver targeting. Other examples of highly-expressed genes are known.

Liver-Associated Blood Disorders, Especially Hemophilia and in Particular Hemophilia B Successful gene editing of hepatocytes has been achieved in mice (both in vitro and in vivo) and in non-human primates (in vivo), showing that treatment of blood disorders through gene editing/genome engineering in hepatocytes is feasible. In particular, expression of the human F9 (hF9) gene in hepatocytes has been shown in non-human primates indicating a treatment for Hemophillia B in humans.

Wechsler et al. reported at the 57th Annual Meeting and Exposition of the American Society of Hematology (abstract presented 6 Dec. 2015 and available online at ash.confex.com/ash/2015/webprogram/Paper86495.html) that they has successfully expressed human F9 (hF9) from hepatocytes in non-human primates through in vivo gene editing. This was achieved using 1) two zinc finger nucleases (ZFNs) targeting intron 1 of the albumin locus, and 2) a human F9 donor template construct. The ZFNs and donor template were encoded on separate hepatotropic adeno-associated virus serotype 2/6 (AAV2/6) vectors injected intravenously, resulting in targeted insertion of a corrected copy of the hF9 gene into the albumin locus in a proportion of liver hepatocytes.

The albumin locus was selected as a "safe harbor" as production of this most abundant plasma protein exceeds 10 g/day, and moderate reductions in those levels are well-tolerated. Genome edited hepatocytes produced normal hFIX (hF9) in therapeutic quantities, rather than albumin, driven by the highly active albumin enhancer/promoter. Targeted integration of the hF9 transgene at the albumin locus and splicing of this gene into the albumin transcript was shown.

Mice studies: C57BL/6 mice were administered vehicle (n=20) or AAV2/6 vectors (n=25) encoding mouse surrogate reagents at 1.0×1013 vector genome (vg)/kg via tail vein injection. ELISA analysis of plasma hFIX in the treated mice showed peak levels of 50-1053 ng/mL that were sustained for the duration of the 6-month study. Analysis of FIX activity from mouse plasma confirmed bioactivity commensurate with expression levels.

Non-human primate (NHP) studies: a single intravenous co-infusion of AAV2/6 vectors encoding the NHP targeted albumin-specific ZFNs and a human F9 donor at 1.2×1013 vg/kg (n=5/group) resulted in >50 ng/mL (>1% of normal) in this large animal model. The use of higher AAV2/6 doses (up to 1.5×1014 vg/kg) yielded plasma hFIX levels up to 1000 ng/ml (or 20% of normal) in several animals and up to 2000 ng/ml (or 50% of normal) in a single animal, for the duration of the study (3 months).

The treatment was well tolerated in mice and NHPs, with no significant toxicological findings related to AAV2/6 ZFN+donor treatment in either species at therapeutic doses. Sangamo (CA, USA) has since applied to the FDA, and been granted, permission to conduct the world's first human clinical trial for an in vivo genome editing application. This follows on the back of the EMEA's approval of the Glybera gene therapy treatment of lipoprotein lipase deficiency.

Accordingly, it is preferred, in some embodiments, that any or all of the following are used:
- AAV (especially AAV2/6) vectors, preferably administered by intravenous injection;
- Albumin as target for gene editing/insertion of transgene/template—especially at intron 1 of albumin;
- human F9 donor template; and/or
- a promoterless donor template.

Hemophilia B

Accordingly, in some embodiments, it is preferred that the present invention is used to treat Hemophilia B. As such it is preferred that a template is provided and that this is the human F9 gene. It will be appreciated that the hF9 template comprises the wt or 'correct' version of hF9 so that the treatment is effective.

In an alternative embodiment, the hemophilia B version of F9 may be delivered so as to create a model organism, cell or cell line (for example a murine or non-human primate model organism, cell or cell line), the model organism, cell or cell line having or carrying the Hemophilia B phenotype, i.e. an inability to produce wt F9.

Hemophilia A

In some embodiments, the F9 (factor IX) gene may be replaced by the F8 (factor VIII) gene described above, leading to treatment of Hemophilia A (through provision of a correct F8 gene) and/or creation of a Hemophilia A model organism, cell or cell line (through provision of an incorrect, Hemophilia A version of the F8 gene).

Hemophilia C

In some embodiments, the F9 (factor IX) gene may be replaced by the F11 (factor XI) gene described above, leading to treatment of Hemophilia C (through provision of a correct F11 gene) and/or creation of a Hemophilia C model organism, cell or cell line (through provision of an incorrect, Hemophilia C version of the F11 gene).

Treating Epithelial and Lung Diseases

The present invention also contemplates delivering the CRISPR-Cas system described herein, e.g. Cpf1 effector protein systems, to one or both lungs.

Although AAV-2-based vectors were originally proposed for CFTR delivery to CF airways, other serotypes such as AAV-1, AAV-5, AAV-6, and AAV-9 exhibit improved gene transfer efficiency in a variety of models of the lung epithelium (see, e.g., Li et al., Molecular Therapy, vol. 17 no. 12, 2067-277 December 2009). AAV-1 was demonstrated to be ~100-fold more efficient than AAV-2 and AAV-5 at transducing human airway epithelial cells in vitro, 5 although AAV-1 transduced murine tracheal airway epithelia in vivo with an efficiency equal to that of AAV-5. Other studies have shown that AAV-5 is 50-fold more efficient than AAV-2 at gene delivery to human airway epithelium (HAE) in vitro and significantly more efficient in the mouse lung airway epithelium in vivo. AAV-6 has also been shown to be more efficient than AAV-2 in human airway epithelial cells in vitro and murine airways in vivo.8 The more recent isolate, AAV-9, was shown to display greater gene transfer efficiency than AAV-5 in murine nasal and alveolar epithelia in vivo with gene expression detected for over 9 months suggesting AAV may enable long-term gene expression in vivo, a desirable property for a CFTR gene delivery vector. Furthermore, it was demonstrated that AAV-9 could be readministered to the murine lung with no loss of CFTR expression and minimal immune consequences. CF and non-CF HAE cultures may be inoculated on the apical surface with 100 μl of AAV vectors for hours (see, e.g., Li et al., Molecular Therapy, vol. 17 no. 12, 2067-277 December 2009). The MOI may vary from $1 \times 10^3$ to $4 \times 10^5$ vector genomes/cell, depending on virus concentration and purposes of the experiments. The above cited vectors are contemplated for the delivery and/or administration of the invention. Zamora et al. (Am J Respir Crit Care Med Vol 183. pp 531-538, 2011) reported an example of the application of an RNA interference therapeutic to the treatment of human infectious disease and also a randomized trial of an antiviral drug in respiratory syncytial virus (RSV)-infected lung transplant recipients. Zamora et al. performed a randomized, double-blind, placebocontrolled trial in LTX recipients with RSV respiratory tract infection. Patients were permitted to receive standard of care for RSV. Aerosolized ALN-RSVO1 (0.6 mg/kg) or placebo was administered daily for 3 days. This study demonstrates that an RNAi therapeutic targeting RSV can be safely administered to LTX recipients with RSV infection. Three daily doses of ALN-RSV01 did not result in any exacerbation of respiratory tract symptoms or impairment of lung function and did not exhibit any systemic proinflammatory effects, such as induction of cytokines or CRP. Pharmacokinetics showed only low, transient systemic exposure after inhalation, consistent with preclinical animal data showing that ALN-RSVO1, administered intravenously or by inhalation, is rapidly cleared from the circulation through exonuclease-mediated digestion and renal excretion. The method of Zamora et al. may be applied to the nucleic acid-targeting system of the present invention and an aerosolized CRISPR Cas, for example with a dosage of 0.6 mg/kg, may be contemplated for the present invention.

Subjects treated for a lung disease may for example receive pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector. In this instance, the following constructs are provided as examples: Cbh or EF1a promoter for Cas (Cpf1), U6 or H1 promoter for guide RNA), A preferred arrangement is to use a CFTRdelta508 targeting guide, a repair template for deltaF508 mutation and a codon optimized Cpf1 enzyme, with optionally one or more nuclear localization signal or sequence(s) (NLS(s)), e.g., two (2) NLSs. Constructs without NLS are also envisaged.

Treating Diseases of the Muscular System

The present invention also contemplates delivering the CRISPR-Cas system described herein, e.g. Cpf1 effector protein systems, to muscle(s).

Bortolanza et al. (Molecular Therapy vol. 19 no. 11, 2055-264 November 2011) shows that systemic delivery of RNA interference expression cassettes in the FRG1 mouse, after the onset of facioscapulohumeral muscular dystrophy (FSHD), led to a dose-dependent long-term FRG1 knockdown without signs of toxicity. Bortolanza et al. found that a single intravenous injection of $5 \times 10^{12}$ vg of rAAV6-sh1FRG1 rescues muscle histopathology and muscle function of FRG1 mice. In detail, 200 µl containing $2 \times 10^{12}$ or $5 \times 10^{12}$ vg of vector in physiological solution were injected into the tail vein using a 25-gauge Terumo syringe. The method of Bortolanza et al. may be applied to an AAV expressing CRISPR Cas and injected into humans at a dosage of about $2 \times 10^{15}$ or $2 \times 10^{16}$ vg of vector.

Dumonceaux et al. (Molecular Therapy vol. 18 no. 5, 881-887 May 2010) inhibit the myostatin pathway using the technique of RNA interference directed against the myostatin receptor AcvRIIb mRNA (sh-AcvRIIb). The restoration of a quasi-dystrophin was mediated by the vectorized U7 exon-skipping technique (U7-DYS). Adeno-associated vectors carrying either the sh-AcvrIIb construct alone, the U7-DYS construct alone, or a combination of both constructs were injected in the tibialis anterior (TA) muscle of dystrophic mdx mice. The injections were performed with $10^{11}$ AAV viral genomes. The method of Dumonceaux et al. may be applied to an AAV expressing CRISPR Cas and injected into humans, for example, at a dosage of about $10^{14}$ to about $10^{15}$ vg of vector.

Kinouchi et al. (Gene Therapy (2008) 15, 1126-1130) report the effectiveness of in vivo siRNA delivery into skeletal muscles of normal or diseased mice through nanoparticle formation of chemically unmodified siRNAs with atelocollagen (ATCOL). ATCOL-mediated local application of siRNA targeting myostatin, a negative regulator of skeletal muscle growth, in mouse skeletal muscles or intravenously, caused a marked increase in the muscle mass within a few weeks after application. These results imply that ATCOL-mediated application of siRNAs is a powerful tool for future therapeutic use for diseases including muscular atrophy. MstsiRNAs (final concentration, 10 mM) were mixed with ATCOL (final concentration for local administration, 0.5%) (AteloGene, Kohken, Tokyo, Japan) according to the manufacturer's instructions. After anesthesia of mice (20-week-old male C57BL/6) by Nembutal (25 mg/kg, i.p.), the Mst-siRNA/ATCOL complex was injected into the masseter and biceps femoris muscles. The method of Kinouchi et al. may be applied to CRISPR Cas and injected into a human, for example, at a dosage of about 500 to 1000 ml of a 40 µM solution into the muscle. Hagstrom et al. (Molecular Therapy Vol. 10, No. 2, August 2004) describe an intravascular, nonviral methodology that enables efficient and repeatable delivery of nucleic acids to muscle cells (myofibers) throughout the limb muscles of mammals. The procedure involves the injection of naked plasmid DNA or siRNA into a distal vein of a limb that is transiently isolated by a tourniquet or blood pressure cuff. Nucleic acid delivery to myofibers is facilitated by its rapid injection in sufficient volume to enable extravasation of the nucleic acid solution into muscle tissue. High levels of transgene expression in skeletal muscle were achieved in both small and large animals with minimal toxicity. Evidence of siRNA delivery to limb muscle was also obtained. For plasmid DNA intravenous injection into a rhesus monkey, a threeway stopcock was connected to two syringe pumps (Model PHD 2000; Harvard Instruments), each loaded with a single syringe. Five minutes after a papaverine injection, pDNA (15.5 to 25.7 mg in 40 –100 ml saline) was injected at a rate of 1.7 or 2.0 ml/s. This could be scaled up for plasmid DNA expressing CRISPR Cas of the present invention with an injection of about 300 to 500 mg in 800 to 2000 ml saline for a human. For adenoviral vector injections into a rat, $2 \times 10^9$ infectious particles were injected in 3 ml of normal saline solution (NSS). This could be scaled up for an adenoviral vector expressing CRISPR Cas of the present invention with an injection of about $1 \times 10^{13}$ infectious particles were injected in 10 liters of NSS for a human. For siRNA, a rat was injected into the great saphenous vein with 12.5 µg of a siRNA and a primate was injected injected into the great saphenous vein with 750 µg of a siRNA. This could be scaled up for a CRISPR Cas of the present invention, for example, with an injection of about 15 to about 50 mg into the great saphenous vein of a human.

See also, for example, WO2013163628 A2, Genetic Correction of Mutated Genes, published application of Duke University describes efforts to correct, for example, a frameshift mutation which causes a premature stop codon and a truncated gene product that can be corrected via nuclease mediated non-homologous end joining such as those responsible for Duchenne Muscular Dystrophy, ("DMD") a recessive, fatal, X-linked disorder that results in muscle degeneration due to mutations in the dystrophin gene. The majority of dystrophin mutations that cause DMD are deletions of exons that disrupt the reading frame and cause premature translation termination in the dystrophin gene. Dystrophin is a cytoplasmic protein that provides structural stability to the dystroglycan complex of the cell membrane that is responsible for regulating muscle cell integrity and function. The dystrophin gene or "DMD gene" as used interchangeably herein is 2.2 megabases at locus Xp21. The primary transcription measures about 2,400 kb with the mature mRNA being about 14 kb. 79 exons code for the protein which is over 3500 amino acids. Exon 51 is frequently adjacent to frame-disrupting deletions in DMD patients and has been targeted in clinical trials for oligonucleotide-based exon skipping. A clinical trial for the exon 51 skipping compound eteplirsen recently reported a significant functional benefit across 48 weeks, with an average of 47% dystrophin positive fibers compared to baseline. Mutations in exon 51 are ideally suited for permanent correction by NHEJ-based genome editing.

The methods of US Patent Publication No. 20130145487 assigned to Cellectis, which relates to meganuclease variants to cleave a target sequence from the human dystrophin gene (DMD), may also be modified to for the nucleic acid-targeting system of the present invention.

Treating Diseases of the Skin

The present invention also contemplates delivering the CRISPR-Cas system described herein, e.g. Cpf1 effector protein systems, to the skin.

Hickerson et al. (Molecular Therapy—Nucleic Acids (2013) 2, e129) relates to a motorized microneedle array skin delivery device for delivering self-delivery (sd)-siRNA to human and murine skin. The primary challenge to translating siRNA-based skin therapeutics to the clinic is the development of effective delivery systems. Substantial effort has been invested in a variety of skin delivery technologies with limited success. In a clinical study in which skin was treated with siRNA, the exquisite pain associated with the hypodermic needle injection precluded enrollment of additional patients in the trial, highlighting the need for improved, more "patient-friendly" (i.e., little or no pain) delivery approaches. Microneedles represent an efficient way to deliver large charged cargos including siRNAs across the primary barrier, the stratum corneum, and are generally regarded as less painful than conventional hypodermic needles. Motorized "stamp type" microneedle devices, including the motorized microneedle array (MMNA) device used by Hickerson et al., have been shown to be safe in hairless mice studies and cause little or no pain as evidenced by (i) widespread use in the cosmetic industry and (ii) limited testing in which nearly all volunteers found use of the device to be much less painful than a flushot, suggesting siRNA delivery using this device will result in much less pain than was experienced in the previous clinical trial using hypodermic needle injections. The MMNA device (marketed as Triple-M or Tri-M by Bomtech Electronic Co, Seoul, South Korea) was adapted for delivery of siRNA to mouse and human skin. sd-siRNA solution (up to 300 µl of 0.1 mg/ml RNA) was introduced into the chamber of the disposable Tri-M needle cartridge (Bomtech), which was set to a depth of 0.1 mm. For treating human skin, deidentified skin (obtained immediately following surgical procedures) was manually stretched and pinned to a cork platform before treatment. All intradermal injections were performed using an insulin syringe with a 28-gauge 0.5-inch needle. The MMNA device and method of Hickerson et al. could be used and/or adapted to deliver the CRISPR Cas of the present invention, for example, at a dosage of up to 300 µl of 0.1 mg/ml CRISPR Cas to the skin.

Leachman et al. (Molecular Therapy, vol. 18 no. 2, 442-446 February 2010) relates to a phase Ib clinical trial for treatment of a rare skin disorder pachyonychia congenita (PC), an autosomal dominant syndrome that includes a disabling plantar keratoderma, utilizing the first short-interfering RNA (siRNA)-based therapeutic for skin. This siRNA, called TD101, specifically and potently targets the keratin 6a (K6a) N171K mutant mRNA without affecting wild-type K6a mRNA.

Zheng et al. (PNAS, Jul. 24, 2012, vol. 109, no. 30, 11975-11980) show that spherical nucleic acid nanoparticle conjugates (SNA-NCs), gold cores surrounded by a dense shell of highly oriented, covalently immobilized siRNA, freely penetrate almost 100% of keratinocytes in vitro, mouse skin, and human epidermis within hours after application. Zheng et al. demonstrated that a single application of 25 nM epidermal growth factor receptor (EGFR) SNA-NCs for 60 h demonstrate effective gene knockdown in human skin. A similar dosage may be contemplated for CRISPR Cas immobilized in SNA-NCs for administration to the skin.

Cancer

In some embodiments, the treatment, prophylaxis or diagnosis of cancer is provided. The target is preferably one or more of the FAS, BID, CTLA4, PDCD1, CBLB, PTPN6, TRAC or TRBC genes. The cancer may be one or more of lymphoma, chronic lymphocytic leukemia (CLL), B cell acute lymphocytic leukemia (B-ALL), acute lymphoblastic leukemia, acute myeloid leukemia, non-Hodgkin's lymphoma (NHL), diffuse large cell lymphoma (DLCL), multiple myeloma, renal cell carcinoma (RCC), neuroblastoma, colorectal cancer, breast cancer, ovarian cancer, melanoma, sarcoma, prostate cancer, lung cancer, esophageal cancer, hepatocellular carcinoma, pancreatic cancer, astrocytoma, mesothelioma, head and neck cancer, and medulloblastoma. This may be implemented with engineered chimeric antigen receptor (CAR) T cell. This is described in WO2015161276, the disclosure of which is hereby incorporated by reference and described herein below.

Target genes suitable for the treatment or prophylaxis of cancer may include, in some embodiments, those described in WO2015048577 the disclosure of which is hereby incorporated by reference.

Particular targets of interest in the context of cancer treatment are oncogenes, such as PIK3CA or KRAS. In particular embodiment, the Cpf1 effector protein is used to destroy tumors by knocking out gain of function RAS mutant genes. The members of the ras gene family, which are small GTPase superfamily are implicated in various malignancies including lung adenocarcinoma, mucinous adenoma, ductal carcinoma of the pancreas and colorectal carcinoma. Examples of suitable guide sequences for targeting the RAS oncogene are known in the art and include but are not limited to CTGAATTAGCTGTATCGTCA (SEQ ID NO: 29) and GAATATAAACTTGTGGTAGT (SEQ ID NO: 30).

Usher Syndrome or Retinitis Pigmentosa-39

In some embodiments, the treatment, prophylaxis or diagnosis of Usher Syndrome or retinitis pigmentosa-39 is provided. The target is preferably the USH2A gene. In some embodiments, correction of a G deletion at position 2299 (2299delG) is provided. This is described in WO2015134812A1, the disclosure of which is hereby incorporated by reference.

Cystic Fibrosis (CF)

In some embodiments, the treatment, prophylaxis or diagnosis of cystic fibrosis is provided. The target is preferably the SCNN1A or the CFTR gene. This is described in WO2015157070, the disclosure of which is hereby incorporated by reference.

Schwank et al. (Cell Stem Cell, 13:653-58, 2013) used CRISPR-Cas9 to correct a defect associated with cystic fibrosis in human stem cells. The team's target was the gene for an ion channel, cystic fibrosis transmembrane conductor receptor (CFTR). A deletion in CFTR causes the protein to misfold in cystic fibrosis patients. Using cultured intestinal stem cells developed from cell samples from two children with cystic fibrosis, Schwank et al. were able to correct the defect using CRISPR along with a donor plasmid containing the reparative sequence to be inserted. The researchers then grew the cells into intestinal "organoids," or miniature guts, and showed that they functioned normally. In this case, about half of clonal organoids underwent the proper genetic correction.

HIV and AIDS

In some embodiments, the treatment, prophylaxis or diagnosis of HIV and AIDS is provided. The target is preferably the CCR5 gene in HIV. This is described in WO2015148670A1, the disclosure of which is hereby incorporated by reference.

Beta Thalassaemia

In some embodiments, the treatment, prophylaxis or diagnosis of Beta Thalassaemia is provided. The target is preferably the BCL11A gene. This is described in WO2015148860, the disclosure of which is hereby incorporated by reference.

Sickle Cell Disease (SCD)

In some embodiments, the treatment, prophylaxis or diagnosis of Sickle Cell Disease (SCD) is provided. The target is preferably the HBB or BCL11A gene. This is described in WO2015148863, the disclosure of which is hereby incorporated by reference.

Herpes Simplex Virus 1 and 2

In some embodiments, the treatment, prophylaxis or diagnosis of HSV-1 (Herpes Simplex Virus 1) is provided. The target is preferably the UL19, UL30, UL48 or UL50 gene in HSV-1. This is described in WO2015153789, the disclosure of which is hereby incorporated by reference.

In other embodiments, the treatment, prophylaxis or diagnosis of HSV-2 (Herpes Simplex Virus 2) is provided. The target is preferably the UL19, UL30, UL48 or UL50 gene in HSV-2. This is described in WO2015153791, the disclosure of which is hereby incorporated by reference.

In some embodiments, the treatment, prophylaxis or diagnosis of Primary Open Angle Glaucoma (POAG) is provided. The target is preferably the MYOC gene. This is described in WO2015153780, the disclosure of which is hereby incorporated by reference.

Adoptive Cell Therapies

The present invention also contemplates use of the CRISPR-Cas system described herein, e.g. Cpf1 effector protein systems, to modify cells for adoptive therapies. Aspects of the invention accordingly involve the adoptive transfer of immune system cells, such as T cells, specific for selected antigens, such as tumor associated antigens (see Maus et al., 2014, Adoptive Immunotherapy for Cancer or Viruses, Annual Review of Immunology, Vol. 32: 189-225; Rosenberg and Restifo, 2015, Adoptive cell transfer as personalized immunotherapy for human cancer, Science Vol. 348 no. 6230 pp. 62-68; and, Restifo et al., 2015, Adoptive immunotherapy for cancer: harnessing the T cell response. Nat. Rev. Immunol. 12(4): 269-281). Various strategies may for example be employed to genetically modify T cells by altering the specificity of the T cell receptor (TCR) for example by introducing new TCR $\alpha$ and $\beta$ chains with selected peptide specificity (see U.S. Pat. No. 8,697,854; PCT Patent Publications: WO2003020763, WO2004033685, WO2004044004, WO2005114215, WO2006000830, WO2008038002, WO2008039818, WO2004074322, WO2005113595, WO2006125962, WO2013166321, WO2013039889, WO2014018863, WO2014083173; U.S. Pat. No. 8,088,379).

As an alternative to, or addition to, TCR modifications, chimeric antigen receptors (CARs) may be used in order to generate immunoresponsive cells, such as T cells, specific for selected targets, such as malignant cells, with a wide variety of receptor chimera constructs having been described (see U.S. Pat. Nos. 5,843,728; 5,851,828; 5,912,170; 6,004,811; 6,284,240; 6,392,013; 6,410,014; 6,753,162; 8,211,422; and, PCT Publication WO9215322). Alternative CAR constructs may be characterized as belonging to successive generations. First-generation CARs typically consist of a single-chain variable fragment of an antibody specific for an antigen, for example comprising a VL linked to a VH of a specific antibody, linked by a flexible linker, for example by a CD8α hinge domain and a CD8α transmembrane domain, to the transmembrane and intracellular signaling domains of either CD3ζ or FcRγ (scFv-CD3ζ or scFv-FcRγ; see U.S. Pat. Nos. 7,741,465; 5,912,172; 5,906,936). Second-generation CARs incorporate the intracellular domains of one or more costimulatory molecules, such as CD28, OX40 (CD134), or 4-1BB (CD137) within the endodomain (for example scFv-CD28/OX40/4-1BB-CD3ζ; see U.S. Pat. Nos. 8,911,993; 8,916,381; 8,975,071; 9,101,584; 9,102,760; 9,102,761). Third-generation CARs include a combination of costimulatory endodomains, such a CD3ζ-chain, CD97, GDI la-CD18, CD2, ICOS, CD27, CD154, CDS, OX40, 4-1BB, or CD28 signaling domains (for example scFv-CD28-4-1BB-CD3ζ or scFv-CD28-OX40-CD3ζ; see U.S. Pat. Nos. 8,906,682; 8,399,645; 5,686,281; PCT Publication No. WO2014134165; PCT Publication No. WO2012079000). Alternatively, costimulation may be orchestrated by expressing CARs in antigen-specific T cells, chosen so as to be activated and expanded following engagement of their native αβTCR, for example by antigen on professional antigen-presenting cells, with attendant costimulation. In addition, additional engineered receptors may be provided on the immunoresponsive cells, for example to improve targeting of a T-cell attack and/or minimize side effects.

Alternative techniques may be used to transform target immunoresponsive cells, such as protoplast fusion, lipofection, transfection or electroporation. A wide variety of vectors may be used, such as retroviral vectors, lentiviral vectors, adenoviral vectors, adeno-associated viral vectors, plasmids or transposons, such as a Sleeping Beauty transposon (see U.S. Pat. Nos. 6,489,458; 7,148,203; 7,160,682; 7,985,739; 8,227,432), may be used to introduce CARs, for example using 2nd generation antigen-specific CARs signaling through CD3ζ and either CD28 or CD137. Viral vectors may for example include vectors based on HIV, SV40, EBV, HSV or BPV.

Cells that are targeted for transformation may for example include T cells, Natural Killer (NK) cells, cytotoxic T lymphocytes (CTL), regulatory T cells, human embryonic stem cells, tumor-infiltrating lymphocytes (TIL) or a pluripotent stem cell from which lymphoid cells may be differentiated. T cells expressing a desired CAR may for example be selected through co-culture with γ-irradiated activating and propagating cells (AaPC), which co-express the cancer antigen and co-stimulatory molecules. The engineered CAR T-cells may be expanded, for example by co-culture on AaPC in presence of soluble factors, such as IL-2 and IL-21. This expansion may for example be carried out so as to provide memory CAR+ T cells (which may for example be assayed by non-enzymatic digital array and/or multi-panel flow cytometry). In this way, CAR T cells may be provided that have specific cytotoxic activity against antigen-bearing tumors (optionally in conjunction with production of desired chemokines such as interferon-γ). CAR T cells of this kind may for example be used in animal models, for example to threat tumor xenografts.

Approaches such as the foregoing may be adapted to provide methods of treating and/or increasing survival of a subject having a disease, such as a neoplasia, for example by administering an effective amount of an immunoresponsive cell comprising an antigen recognizing receptor that binds a selected antigen, wherein the binding activates the immunoreponsive cell, thereby treating or preventing the disease (such as a neoplasia, a pathogen infection, an autoimmune disorder, or an allogeneic transplant reaction). Dosing in CAR T cell therapies may for example involve administration of from 106 to 109 cells/kg, with or without a course of lymphodepletion, for example with cyclophosphamide.

To guard against possible adverse reactions, engineered immunoresponsive cells may be equipped with a transgenic safety switch, in the form of a transgene that renders the cells vulnerable to exposure to a specific signal. For example, the herpes simplex viral thymidine kinase (TK) gene may be used in this way, for example by introduction into allogeneic T lymphocytes used as donor lymphocyte infusions following stem cell transplantation. In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-1683; Sadelain M, The New England Journal of Medicine 2011; 365:1735-173; Ramos et al., Stem Cells 28(6):1107-15 (2010)).

In a further refinement of adoptive therapies, genome editing with a CRISPR-Cas system as described herein may be used to tailor immunoresponsive cells to alternative implementations, for example providing edited CAR T cells (see Poirot et al., 2015, Multiplex genome edited T-cell manufacturing platform for "off-the-shelf" adoptive T-cell immunotherapies, Cancer Res 75 (18): 3853). For example, immunoresponsive cells may be edited to delete expression of some or all of the class of HLA type II and/or type I molecules, or to knockout selected genes that may inhibit the desired immune response, such as the PD1 gene.

Gene Drives

The present invention also contemplates use of the CRISPR-Cas system described herein, e.g. Cpf1 effector protein systems, to provide RNA-guided gene drives, for example in systems analogous to gene drives described in PCT Patent Publication WO 2015/105928. Systems of this kind may for example provide methods for altering eukaryotic germline cells, by introducing into the germline cell a nucleic acid sequence encoding an RNA-guided DNA nuclease and one or more guide RNAs. The guide RNAs may be designed to be complementary to one or more target locations on genomic DNA of the germline cell. The nucleic acid sequence encoding the RNA guided DNA nuclease and the nucleic acid sequence encoding the guide RNAs may be provided on constructs between flanking sequences, with promoters arranged such that the germline cell may express the RNA guided DNA nuclease and the guide RNAs, together with any desired cargo-encoding sequences that are also situated between the flanking sequences. The flanking sequences will typically include a sequence which is identical to a corresponding sequence on a selected target chromosome, so that the flanking sequences work with the components encoded by the construct to facilitate insertion of the foreign nucleic acid construct sequences into genomic DNA at a target cut site by mechanisms such as homologous recombination, to render the germline cell homozygous for the foreign nucleic acid sequence. In this way, gene-drive systems are capable of introgressing desired cargo genes throughout a breeding population (Gantz et al., 2015, Highly efficient Cas9-mediated gene drive for population modification of the malaria vector mosquito *Anopheles stephensi*, PNAS 2015, published ahead of print Nov. 23, 2015, doi: 10.1073/pnas.1521077112; Esvelt et al., 2014, Concerning RNA-guided gene drives for the alteration of wild populations eLife 2014; 3:e03401). In select embodiments, target sequences may be selected which have few potential off-target sites in a genome. Targeting multiple sites within a target locus, using multiple guide RNAs, may increase the cutting frequency and hinder the evolution of drive resistant alleles. Truncated guide RNAs may reduce off-target cutting. Paired nickases may be used instead of a single nuclease, to further increase specificity. Gene drive constructs may include cargo sequences encoding transcriptional regulators, for example to activate homologous recombination genes and/or repress non-homologous end-joining. Target sites may be chosen within an essential gene, so that non-homologous end-joining events may cause lethality rather than creating a drive-resistant allele. The gene drive constructs can be engineered to function in a range of hosts at a range of temperatures (Cho et al. 2013, Rapid and Tunable Control of Protein Stability in *Caenorhabditis elegans* Using a Small Molecule, PLoS ONE 8(8): e72393. doi:10.1371/journal.pone.0072393).

Xenotransplantation

The present invention also contemplates use of the CRISPR-Cas system described herein, e.g. Cpf1 effector protein systems, to provide RNA-guided DNA nucleases adapted to be used to provide modified tissues for transplantation. For example, RNA-guided DNA nucleases may be used to knockout, knockdown or disrupt selected genes in an animal, such as a transgenic pig (such as the human heme oxygenase-1 transgenic pig line), for example by disrupting expression of genes that encode epitopes recognized by the human immune system, i.e. xenoantigen genes. Candidate porcine genes for disruption may for example include α(1, 3)-galactosyltransferase and cytidine monophosphate-N-acetylneuraminic acid hydroxylase genes (see PCT Patent Publication WO 2014/066505). In addition, genes encoding endogenous retroviruses may be disrupted, for example the genes encoding all porcine endogenous retroviruses (see Yang et al., 2015, Genome-wide inactivation of porcine endogenous retroviruses (PERVs), Science 27 Nov. 2015: Vol. 350 no. 6264 pp. 1101-1104). In addition, RNA-guided DNA nucleases may be used to target a site for integration of additional genes in xenotransplant donor animals, such as a human CD55 gene to improve protection against hyperacute rejection.

General Gene Therapy Considerations

Examples of disease-associated genes and polynucleotides amd disease specific information is available from McKusick-Nathans Institute of Genetic Medicine, Johns Hopkins University (Baltimore, Md.) and National Center for Biotechnology Information, National Library of Medicine (Bethesda, Md.), available on the World Wide Web.

Mutations in these genes and pathways can result in production of improper proteins or proteins in improper amounts which affect function. Further examples of genes, diseases and proteins are hereby incorporated by reference from U.S. Provisional application 61/736,527 filed Dec. 12, 2012. Such genes, proteins and pathways may be the target polynucleotide of a CRISPR complex of the present invention. Examples of disease-associated genes and polynucleotides are listed in Tables A and B. Examples of signaling biochemical pathway-associated genes and polynucleotides are listed in Table C.

TABLE A

| DISEASE/DISORDERS | GENE(S) |
|---|---|
| Neoplasia | PTEN; ATM; ATR; EGFR; ERBB2; ERBB3; ERBB4; Notch1; Notch2; Notch3; Notch4; AKT; AKT2; AKT3; HIF; HIF1a; HIF3a; Met; |

TABLE A-continued

| DISEASE/DISORDERS | GENE(S) |
|---|---|
| | HRG; Bcl2; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bcl2; caspases family (9 members: 1, 2, 3, 4, 6, 7, 8, 9, 12); Kras; Ape |
| Age-related Macular Degeneration | Aber; Ccl2; Cc2; cp (ceruloplasmin); Timp3; cathepsinD; Vldlr; Ccr2 |
| Schizophrenia | Neuregulin1 (Nrg1); Erb4 (receptor for Neuregulin); Complexin1 (Cplx1); Tph1 Tryptophan hydroxylase; Tph2 Tryptophan hydroxylase 2; Neurexin 1; GSK3; GSK3a; GSK3b |
| Disorders | 5-HTT (Slc6a4); COMT; DRD (Drd1a); SLC6A3; DAOA; DTNBP1; Dao (Dao1) |
| Trinucleotide Repeat Disorders | HTT (Huntington's Dx); SBMA/SMAX1/AR (Kennedy's Dx); FWX25 (Friedrich's Ataxia); ATX3 (Machado-Joseph's Dx); ATXN1 and ATXN2 (spinocerebellar ataxias); DMPK (myotonic dystrophy); Atrophin-1 and Atn1 (DRPLA Dx); CBP (Creb-BP—global instability); VLDLR (Alzheimer's); Atxn7; Atxn10 |
| Fragile X Syndrome | FMR2; FXR1; FXR2; mGLUR5 |
| Secretase Related Disorders | APH-1 (alpha and beta); Presenilin (Psen1); nicastrin (Ncstn); PEN-2 |
| Others | Nos1; Parp1; Nat1; Nat2 |
| Prion—related disorders | Prp |
| ALS | SOD1; ALS2; STEX; FUS; TARDBP; VEGF (VEGF-a; VEGF-b; VEGF-c) |
| Drug addiction | Prkce (alcohol); Drd2; Drd4; ABAT (alcohol); GRIA2; Grm5; Grin1; Htr1b; Grin2a; Drd3; Pdyn; Gria1 (alcohol) |
| Autism | Mecp2; BZRAP1; MDGA2; Sema5A; Neurexin 1; Fragile X (FMR2 (AFF2); FXR1; FXR2; Mglur5) |
| Alzheimer's Disease | E1; CHIP; UCH; UBB; Tau; LRP; PICALM; Clusterin; PS1; SORL1; CR1; Vldlr; Uba1; Uba3; CHIP28 (Aqp1, Aquaporin 1); Uchl1; Uchl3; APP |
| Inflammation | IL-10; IL-1 (IL-1a; IL-1b); IL-13; IL-17 (IL-17a (CTLA8); IL-17b; IL-17c; IL-17d; IL-17f); II-23; Cx3cr1; ptpn22; TNFa; NOD2/CARD15 for IBD; IL-6; IL-12 (IL-12a; IL-12b); CTLA4; Cx3cl1 |
| Parkinson's Disease | x-Synuclein; DJ-1; LRRK2; Parkin; PINK1 |

TABLE B

| | |
|---|---|
| Blood and coagulation diseases and disorders | Anemia (CDAN1, CDA1, RPS19, DBA, PKLR, PK1, NT5C3, UMPH1, PSN1, RHAG, RH50A, NRAMP2, SPTB, ALAS2, ANH1, ASB, ABCB7, ABC7, ASAT); Bare lymphocyte syndrome (TAPBP, TPSN, TAP2, ABCB3, PSF2, RING11, MHC2TA, C2TA, RFX5, RFXAP, RFX5); Bleeding disorders (TBXA2R, P2RX1, P2X1); Factor H and factor H-like 1 (HF1, CFH, HUS); Factor V and factor VIII (MCFD2); Factor VII deficiency (F7); Factor X deficiency (F10); Factor XI deficiency (F11); Factor XII deficiency (F12, HAF); Factor XIIIA deficiency (F13A1, F13A); Factor XIIIB deficiency (F13B); Fanconi anemia (FANCA, FACA, FA1, FA, FAA, FAAP95, FAAP90, F1134064, FANCB, FANCC, FACC, BRCA2, FANCD1, FANCD2, FANCD, FACD, FAD, FANCE, FACE, FANCF, XRCC9, FANCG, BRIP1, BACH1, FANCJ, PHF9, FANCL, FANCM, KIAA1596); Hemophagocytic lymphohistiocytosis disorders (PRF1, HPLH2, UNC13D, MUNC13-4, HPLH3, HLH3, FHL3); Hemophilia A (F8, F8C, HEMA); Hemophilia B (F9, HEMB), Hemorrhagic disorders (PI, ATT, F5); Leukocyde deficiencies and disorders (ITGB2, CD18, |

TABLE B-continued

| | |
|---|---|
| | LCAMB, LAD, EIF2B1, EIF2BA, EIF2B2, EIF2B3, EIF2B5, LVWM, CACH, CLE, EIF2B4); Sickle cell anemia (HBB); Thalassemia (HBA2, HBB, HBD, LCRB, HBA1). |
| Cell dysregulation and oncology diseases and disorders | B-cell non-Hodgkin lymphoma (BCL7A, BCL7); Leukemia (TAL1, TCL5, SCL, TAL2, FLT3, NBS1, NBS, ZNFN1A1, IK1, LYF1, HOXD4, HOX4B, BCR, CML, PHL, ALL, ARNT, KRAS2, RASK2, GMPS, AF10, ARHGEF12, LARG, KIAA0382, CALM, CLTH, CEBPA, CEBP, CHIC2, BTL, FLT3, KIT, PBT, LPP, NPM1, NUP214, D9546E, CAN, CAIN, RUNX1, CBFA2, AML1, WHSC1L1, NSD3, FLT3, AF1Q, NPM1, NUMA1, ZNF145, PLZF, PML, MYL, STAT5B, AF10, CALM, CLTH, ARL11, ARLTS1, P2RX7, P2X7, BCR, CML, PHL, ALL, GRAF, NF1, VRNF, WSS, NFNS, PTPN11, PTP2C, SHP2, NS1, BCL2, CCND1, PRAD1, BCL1, TCRA, GATA1, GF1, ERYF1, NFE1, ABL1, NQO1, DIA4, NMOR1, NUP214, D9546E, CAN, CAIN). |
| Inflammation and immune related diseases and disorders | AIDS (KIR3DL1, NKAT3, NKB1, AMB11, KIR3DS1, IFNG, CXCL12, SDF1); Autoimmune lymphoproliferative syndrome (TNFRSF6, APT1, FAS, CD95, ALPS1A); Combined immunodeficiency, (IL2RG, SCIDX1, SCIDX, IMD4); HIV-1 (CCL5, SCYA5, D175136E, TCP228), HIV susceptibility or infection (IL10, CSIF, CMKBR2, CCR2, CMKBR5, CCCKR5 (CCR5)); Immunodeficiencies (CD3E, CD3G, AICDA, AID, HIGM2, TNFRSF5, CD40, UNG, DGU, HIGM4, TNFSF5, CD4OLG, HIGM1, IGM, FOXP3, IPEX, AIID, XPID, PIDX, TNFRSF14B, TACI); Inflammation (IL-10, IL-1 (IL-1a, IL-1b), IL-13, IL-17 (IL-17a (CTLA8), IL-17b, IL-17c, IL-17d, IL-17f), II-23, Cx3cr1, ptpn22, TNFa, NOD2/CARD15 for IBD, IL-6, IL-12 (IL-12a, IL-12b), CTLA4, Cx3cl1); Severe combined immunodeficiencies (SCIDs)(JAK3, JAKL, DCLRE1C, ARTEMIS, SCIDA, RAG1, RAG2, ADA, PTPRC, CD45, LCA, IL7R, CD3D, T3D, IL2RG, SCIDX1, SCIDX, IMD4). |
| Metabolic, liver, kidney and protein diseases and disorders | Amyloid neuropathy (TTR, PALB); Amyloidosis (APOA1, APP, AAA, CVAP, AD1, GSN, FGA, LYZ, TTR, PALB); Cirrhosis (KRT18, KRT8, CIRH1A, NAIC, TEX292, KIAA1988); Cystic fibrosis (CFTR, ABCC7, CF, MRP7); Glycogen storage diseases (SLC2A2, GLUT2, G6PC, G6PT, G6PT1, GAA, LAMP2, LAMPB, AGL, GDE, GBE1, GYS2, PYGL, PFKM); Hepatic adenoma, 142330 (TCF1, HNF1A, MODY3), Hepatic failure, early onset, and neurologic disorder (SCOD1, SCO1), Hepatic lipase deficiency (LIPC), Hepatoblastoma, cancer and carcinomas (CTNNB1, PDGFRL, PDGRL, PRLTS, AXIN1, AXIN, CTNNB1, TP53, P53, LFS1, IGF2R, MPRI, MET, CASP8, MCH5; Medullary cystic kidney disease (UMOD, HNFJ, FJHN, MCKD2, ADMCKD2); Phenylketonuria (PAH, PKU1, QDPR, DHPR, PTS); Polycystic kidney and hepatic disease (FCYT, PKHD1, ARPKD, PKD1, PKD2, PKD4, PKDTS, PRKCSH, G19P1, PCLD, SEC63). |
| Muscular/Skeletal diseases and disorders | Becker muscular dystrophy (DMD, BMD, MYF6), Duchenne Muscular Dystrophy (DMD, BMD); Emery-Dreifuss muscular dystrophy (LMNA, LMN1, EMD2, FPLD, CMD1A, HGPS, LGMD1B, LMNA, LMN1, EMD2, FPLD, CMD1A); Facioscapulohumeral muscular dystrophy (FSHMD1A, FSHD1A); Muscular dystrophy (FKRP, MDC1C, LGMD2I, LAMA2, LAMM, LARGE, KIAA0609, MDC1D, FCMD, TTID, MYOT, CAPN3, CANP3, DYSF, LGMD2B, SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMD1N, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EBS1); Osteopetrosis (LRP5, BMND1, LRP7, LR3, OPPG, VBCH2, CLCN7, CLC7, OPTA2, OSTM1, GL, TCIRG1, TIRC7, OC116, OPTB1); Muscular atrophy (VAPB, VAPC, ALS8, SMN1, |

TABLE B-continued

| | |
|---|---|
| | SMA1, SMA2, SMA3, SMA4, BSCL2, SPG17, GARS, SMAD1, CMT2D, HEXB, IGHMBP2, SMUBP2, CATF1, SMARD1). |
| Neurological and neuronal diseases and disorders | ALS (SOD1, ALS2, STEX, FUS, TARDBP, VEGF (VEGF-a, VEGF-b, VEGF-c); Alzheimer disease (APP, AAA, CVAP, AD1, APOE, AD2, PSEN2, AD4, STM2, APBB2, FE65L1, NOS3, PLAU, URK, ACE, DCP1, ACE1, MPO, PACIP1, PAXIP1L, PTIP, A2M, BLMH, BMH, PSEN1, AD3); Autism (Mecp2, BZRAP1, MDGA2, Sema5A, Neurexin1, GLO1, MECP2, RTT, PPMX, MRX16, MRX79, NLGN3, NLGN4, KIAA1260, AUTSX2); Fragile X Syndrome (FMR2, FXR1, FXR2, mGLUR5); Huntington's disease and disease like disorders (HD, IT15, PRNP, PRIP, JPH3, JP3, HDL2, TBP, SCA17); Parkinson disease (NR4A2, NURR1, NOT, TINUR, SNCAIP, TBP, SCA17, SNCA, NACP, PARK1, PARK4, DJ1, PARK7, LRRK2, PARK8, PINK1, PARK6, UCHL1, PARKS, SNCA, NACP, PARK1, PARK4, PRKN, PARK2, PDJ, DBH, NDUFV2); Rett syndrome (MECP2, RTT, PPMX, MRX, MRX16, MRX79, CDKL5, STK9, MECP2, RTT, PPMX, MRX16, MRX79, x-Synuclein, DJ-1); Schizophrenia (Neuregulin1 (Nrg1), Erb4 (receptor for Neuregulin), Complexin1 (Cplx1), Tph1 Tryptophan hydroxylase, Tph2, Tryptophan hydroxylase 2, Neurexin 1, GSK3, G5K3a, GSK3b, 5-HTT (Slc6a4), COMT, DRD (Drd1a), SLC6A3, DAOA, DTNBP1, Dao (Dao1)); Secretase Related Disorders (APH-1 (alpha and beta), Presenilin (Psen1), nicastrin, (Ncstn), PEN-2, Nos1, Parp1, Nat1, Nat2); Trinucleotide Repeat Disorders (HTT (Huntington's Dx), SBMA/SMAX1/AR (Kennedy's Dx), FWX25 (Friedrich's Ataxia), ATX3 (Machado-Joseph's Dx), ATXN1 and ATXN2 (spinocerebellar ataxias), DMPK (myotonic dystrophy), Atrophin-1 and Atn1 (DRPLA Dx), CBP (Creb-BP—global instability), VLDLR (Alzheimer's), Atxn7, Atxn10). |
| Occular diseases and disorders | Age-related macular degeneration (Abcr, Ccl2, Cc2, cp (ceruloplasmin), Timp3, cathepsinD, Vldlr, Ccr2); Cataract (CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQP0, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1); Corneal clouding and dystrophy (APOA1, TGFBI, CSD2, CDGG1, CSD, BIGH3, CDG2, TACSTD2, TROP2, M1S1, VSX1, RINX, PPCD, PPD, KTCN, COL8A2, FECD, PPCD2, PIP5K3, CFD); Cornea plana congenital (KERA, CNA2); Glaucoma (MYOC, TIGR, GLC1A, JOAG, GPOA, OPTN, GLC1E, FIP2, HYPL, NRP, CYP1B1, GLC3A, OPA1, NTG, NPG, CYP1B1, GLC3A); Leber congenital amaurosis (CRB1, RP12, CRX, CORD2, CRD, RPGRIP1, LCA6, CORD9, RPE65, RP20, AIPL1, LCA4, GUCY2D, GUC2D, LCA1, CORD6, RDH12, LCA3); Macular dystrophy (ELOVL4, ADMD, STGD2, STGD3, RDS, RP7, PRPH2, PRPH, AVMD, AOFMD, VMD2). |

TABLE C

| CELLULAR FUNCTION | GENES |
|---|---|
| PI3K/AKT Signaling | PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKN1B; NFKB2; BCL2; PIK3CB; PPP2R1A; MAPK8; BCL2L1; MAPK3; TSC2; ITGA1; KRAS; EIF4EBP1; RELA; PRKCD; NOS3; PRKAA1; MAPK9; CDK2; PPP2CA; PIM1; ITGB7; YWHAZ; ILK; TP53; RAF 1; IKBKG; RELB; DYRK1A; CDKN1A; ITGB1; MAP2K2; JAK1; AKT1; JAK2; PIK3R1; CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SGK; HSP90AA1; RPS6KB1 |
| ERK/MAPK Signaling | PRKCE; ITGAM; ITGA5; HSPB1; IRAK1; PRKAA2; EIF2AK2; RAC1; RAP1A; TLN1; EIF4E; ELK1; GRK6; MAPK1; RAC2; PLK1; AKT2; PIK3CA; CDK8; CREB1; PRKCI; PTK2; FOS; RPS6KA4; PIK3CB; PPP2R1A; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPP1CC; KSR1; PXN; RAF1; FYN; DYRK1A; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAF; ATF4; PRKCA; SRF; STAT1; SGK |
| Glucocorticoid Receptor Signaling | RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; T5C22D3; MAPK10; NRIP1; KRAS; MAPK13; RELA; STAT5A; MAPK9; NOS2A; PBX1; NR3C1; PIK3C2A; CDKN1C; TRAF2; SERPINE1; NCOA3; MAPK14; TNF; RAF1; IKBKG; MAP3K7; CREBBP; CDKN1A; MAP2K2; JAK1; IL8; NCOA2; AKT1; JAK2; PIK3R1; CHUK; STAT3; MAP2K1; NFKB1; TGFBR1; ESR1; SMAD4; CEBPB; JUN; AR; AKT3; CCL2; MMP1; STAT1; IL6; HSP90AA1 |
| Axonal Guidance Signaling | PRKCE; ITGAM; ROCK1; ITGA5; CXCR4; ADAM12; IGF1; RAC1; RAP1A; EIF4E; PRKCZ; NRP1; NTRK2; ARHGEF7; SMO; ROCK2; MAPK1; PGF; RAC2; PTPN11; GNAS; AKT2; PIK3CA; ERBB2; PRKCI; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GLI1; WNT5A; ADAM10; MAP2K1; PAK3; ITGB3; CDC42; VEGFA; ITGA2; EPHA8; CRKL; RND1; GSK3B; AKT3; PRKCA |
| Ephrin Receptor Signaling | PRKCE; ITGAM; ROCK1; ITGA5; CXCR4; IRAK1; PRKAA2; EIF2AK2; RAC1; RAP1A; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; KRAS; RHOA; PRKCD; PRKAA1; MAPK9; SRC; CDK2; PIM1; ITGB7; PXN; RAF1; FYN; DYRK1A; ITGB1; MAP2K2; PAK4; AKT1; JAK2; STAT3; ADAM10; MAP2K1; PAK3; ITGB3; CDC42; VEGFA; ITGA2; EPHA8; TTK; CSNK1A1; CRKL; BRAF; PTPN13; ATF4; AKT3; SGK |
| Actin Cytoskeleton Signaling | ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGAl; KRAS; RHOA; PRKCD; PRKAA1; MAPK9; CDK2; PIM1; PIK3C2A; ITGB7; PPP1CC; PXN; VIL2; RAF1; GSN; DYRK1A; ITGB1; MAP2K2; PAK4; PIP5K1A; PIK3R1; MAP2K1; PAK3; ITGB3; CDC42; APC; ITGA2; TTK; CSNK1A1; CRKL; BRAF; VAV3; SGK |

TABLE C-continued

| CELLULAR FUNCTION | GENES |
| --- | --- |
| Huntington's Disease Signaling | PRKCE; IGF1; EP300; RCOR1; PRKCZ; HDAC4; TGM2; MAPK1; CAPNS1; AKT2; EGFR; NCOR2; SP1; CAPN2; PIK3CA; HDAC5; CREB1; PRKCI; HSPA5; REST; GNAQ; PIK3CB; PIK3C3; MAPK8; IGF1R; PRKD1; GNB2L1; BCL2L1; CAPN1; MAPK3; CASP8; HDAC2; HDAC7A; PRKCD; HDAC11; MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3 |
| Apoptosis Signaling | PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRK1A; MAP2K2; CHUK; APAF1; MAP2K1; NFKB1; PAK3; LMNA; CASP2; BIRC2; TTK; CSNK1A1; BRAF; BAX; PRKCA; SGK; CASP3; BIRC3; PARP1 |
| B Cell Receptor Signaling | RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1 |
| Leukocyte Extravasation Signaling | ACTN4; CD44; PRKCE; ITGAM; ROCK1; CXCR4; CYBA; RAC1; RAP1A; PRKCZ; ROCK2; RAC2; PTPN11; MNIP14; PIK3CA; PRKCI; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; F11R; ITK; CRKL; VAV3; CTTN; PRKCA; MMP1; MMP9 |
| Integrin Signaling | ACTN4; ITGAM; ROCK1; ITGA5; RAC1; PTEN; RAP1A; TLN1; ARHGEF7; MAPK1; RAC2; CAPNS1; AKT2; CAPN2; PIK3CA; PTK2; PIK3CB; PIK3C3; MAPK8; CAV1; CAPN1; ABL1; MAPK3; ITGA1; KRAS; RHOA; SRC; PIK3C2A; ITGB7; PPP1CC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3 |
| Acute Phase Response Signaling | IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS; MAPK13; IL6R; RELA; SOCS1; MAPK9; FTL; NR3C1; TRAF2; SERPINE1; MAPK14; TNF; RAF1; PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; IL1R1; IL6 |
| PTEN Signaling | ITGAM; ITGA5; RAC1; PTEN; PRKCZ; BCL2L11; MAPK1; RAC2; AKT2; EGFR; IKBKB; CBL; PIK3CA; CDKN1B; PTK2; NFKB2; BCL2; PIK3CB; BCL2L1; MAPK3; ITGA1; KRAS; ITGB7; ILK; PDGFRB; INSR; RAF1; IKBKG; CASP9; CDKN1A; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOXO1; CASP3; RPS6KB1 |
| p53 Signaling | PTEN; EP300; BBC3; PCAF; FASN; BRCA1; GADD45A; BIRC5; AKT2; PIK3CA; CHEK1; TP53INP1; BCL2; PIK3CB; PIK3C3; MAPK8; THBS1; ATR; BCL2L1; E2F1; PMAIP1; CHEK2; TNFRSF 10B ; TP73; RB1; HDAC9; CDK2; PIK3C2A; MAPK14; TP53; LRDD; CDKN1A; HIPK2; AKT1; PIK3R1; RRM2B; APAF1; CTNNB 1; SIRT1; CCND1; PRKDC; ATM; SFN; CDKN2A; JUN; SNAI2; GSK3B; BAX; AKT3 |
| Aryl Hydrocarbon Receptor Signaling | HSPB1; EP300; FASN; TGM2; RXRA; MAPK1; NQO1; NCOR2; SP1; ARNT; CDKN1B; FOS; CHEK1; SMARCA4; NFKB2; MAPK8; ALDH1A1; ATR; E2F1; MAPK3; NRIP1; CHEK2; RELA; TP73; GSTP1; RB1; SRC; CDK2; AHR; NFE2L2; NCOA3; TP53; TNF; CDKN1A; NCOA2; APAF1; NFKB1; CCND1; ATM; ESR1; CDKN2A; MYC; JUN; ESR2; BAX; IL6; CYP1B1; HSP90AA1 |
| Xenobiotic Metabolism Signaling | PRKCE; EP300; PRKCZ; RXRA; MAPK1; NQO1; NCOR2; PIK3CA; ARNT; PRKCI; NFKB2; CAMK2A; PIK3CB; PPP2R1A; PIK3C3; MAPK8; PRKD1; ALDH1A1; MAPK3; NRIP1; KRAS; MAPK13; PRKCD; GSTP1; MAPK9; NOS2A; ABCB1; AHR; PPP2CA; FTL; NFE2L2; PIK3C2A; PPARGC1A; MAPK14; TNF; RAF1; CREBBP; MAP2K2; PIK3R1; PPP2R5C; MAP2K1; NFKB1; KEAP1; PRKCA; EIF2AK3; IL6; CYP1B1; HSP90AA1 |
| SAPK/JNK Signaling | PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRK1A; MAP2K2; PIK3R1; MAP2K1; PAK3; CDC42; JUN; TTK; CSNK1A1; CRKL; BRAF; SGK |
| PPAr/RXR Signaling | PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IRS1; MAPK3; KRAS; RELA; PRKAA1; PPARGC1A; NCOA3; MAPK14; INSR; RAF1; IKBKG; RELB; MAP3K7; CREBBP; MAP2K2; JAK2; CHUK; MAP2K1; NFKB1; TGFBR1; SMAD4; JUN; IL1R1; PRKCA; IL6; HSP90AA1; ADIPOQ |
| NF-KB Signaling | IRAK1; EIF2AK2; EP300; INS; MYD88; PRKCZ; TRAF6; TBK1; AKT2; EGFR; IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4; PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; IL1R1 |
| Neuregulin Signaling | ERBB4; PRKCE; ITGAM; ITGA5; PTEN; PRKCZ; ELK1; MAPK1; PTPN11; AKT2; EGFR; ERBB2; PRKCI; CDKN1B; STAT5B; PRKD1; MAPK3; ITGA1; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HSP90AA1; RPS6KB1 |
| Wnt & Beta catenin Signaling | CD44; EP300; LRP6; DVL3; CSNK1E; GJA1; SMO; AKT2; PIN1; CDH1; BTRC; GNAQ; MARK2; PPP2R1A; WNT11; SRC; DKK1; PPP2CA; SOX6; SFRP2; ILK; LEF1; SOX9; TP53; MAP3K7; CREBBP; TCF7L2; AKT1; PPP2R5C; WNT5A; LRP5; CTNNB1; TGFBR1; CCND1; GSK3A; DVL1; APC; CDKN2A; MYC; CSNK1A1; GSK3B; AKT3; SOX2 |

TABLE C-continued

| CELLULAR FUNCTION | GENES |
|---|---|
| Insulin Receptor Signaling | PTEN; INS; EIF4E; PTPN1; PRKCZ; MAPK1; TSC1; PTPN11; AKT2; CBL; PIK3CA; PRKCI; PIK3CB; PIK3C3; MAPK8; IRS1; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; GSK3A; FRAP1; CRKL; GSK3B; AKT3; FOXO1; SGK; RPS6KB1 |
| IL-6 Signaling | HSPB1; TRAF6; MAPKAPK2; ELK1; MAPK1; PTPN11; IKBKB; FOS; NFKB2; MAP3K14; MAPK8; MAPK3; MAPK10; IL6ST; KRAS; MAPK13; IL6R; RELA; SOCS1; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; IL1R1; SRF; IL6 |
| Hepatic Cholestasis | PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; TRAF2; TLR4; TNF; INSR; IKBKG; RELB; MAP3K7; CHUK; NR1H2; TJP2; NFKB1; ESR1; SREBF1; FGFR4; JUN; IL1R1; PRKCA; IL6 |
| IGF-1 Signaling | IGF1; PRKCZ; ELK1; MAPK1; PTPN11; NEDD4; AKT2; PIK3CA; PRKCI; PTK2; FOS; PIK3CB; PIK3C3; MAPK8; IGF1R; IRS1; MAPK3; IGFBP7; KRAS; PIK3C2A; YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1 |
| NRF2-mediated Oxidative Stress Response | PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1, PIK3R1; MAP2K1; PPM; JUN; KEAP1; GSK3B; ATF4; PRKCA; EIF2AK3; HSP90AA1 |
| Hepatic Fibrosis/Hepatic Stellate Cell Activation | EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; IL1R1; CCL2; HGF; MMP1; STAT1; IL6; CTGF; MMP9 |
| PPAR Signaling | EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; PPARGC1A; PDGFRB; TNF; INSR; RAF1; IKBKG; RELB; MAP3K7; CREBBP; MAP2K2; CHUK; PDGFRA; MAP2K1; NFKB1; JUN; IL1R1; HSP90AA1 |
| Fc Epsilon RI Signaling | PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK10; KRAS; MAPK13; PRKCD; MAPK9; PIK3C2A; BTK; MAPK14; TNF; RAF1; FYN; MAP2K2; AKT1; PIK3R1; PDPK1; MAP2K1; AKT3; VAV3; PRKCA |
| G-Protein Coupled Receptor Signaling | PRKCE; RAP1A; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; STAT3; MAP2K1; NFKB1; BRAF; ATF4; AKT3; PRKCA |
| Inositol Phosphate Metabolism | PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRK1A; MAP2K2; PIP5K1A; PIK3R1; MAP2K1; PAK3; ATM; TTK; CSNK1A1; BRAF; SGK |
| PDGF Signaling | EIF2AK2; ELK1; ABL2; MAPK1; PIK3CA; FOS; PIK3CB; PIK3C3; MAPK8; CAV1; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF; STAT1; SPHK2 |
| VEGF Signaling | ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIF1A; NOS3; PIK3C2A; PXN; RAF1; MAP2K2; ELAVL1; AKT1; PIK3R1; MAP2K1; SFN; VEGFA; AKT3; FOXO1; PRKCA |
| Natural Killer Cell Signaling | PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA |
| Cell Cycle: G1/S Checkpoint Regulation | HDAC4; SMAD3; SUV39H1; HDAC5; CDKN1B; BTRC; ATR; ABL1; E2F1; HDAC2; HDAC7A; RB1; HDAC11; HDAC9; CDK2; E2F2; HDAC3; TP53; CDKN1A; CCND1; E2F4; ATM; RBL2; SMAD4; CDKN2A; MYC; NRG1; GSK3B; RBL1; HDAC6 |
| T Cell Receptor Signaling | RAC1; ELK1; MAPK1; IKBKB; CBL; PIK3CA; FOS; NFKB2; PIK3CB; PIK3C3; MAPK8; MAPK3; KRAS; RELA; PIK3C2A; BTK; LCK; RAF1; IKBKG; RELB; FYN; MAP2K2; PIK3R1; CHUK; MAP2K1; NFKB1; ITK; BCL10; JUN; VAV3 |
| Death Receptor Signaling | CRADD; HSPB1; BID; BIRC4; TBK1; IKBKB; FADD; FAS; NFKB2; BCL2; MAP3K14; MAPK8; RIPK1; CASP8; DAXX; TNFRSF10B; RELA; TRAF2; TNF; IKBKG; RELB; CASP9; CHUK; APAF1; NFKB1; CASP2; BIRC2; CASP3; BIRC3 |
| FGF Signaling | RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; AKT1; PIK3R1; STAT3; MAP2K1; FGFR4; CRKL; ATF4; AKT3; PRKCA; HGF |
| GM-CSF Signaling | LYN; ELK1; MAPK1; PTPN11; AKT2; PIK3CA; CAMK2A; STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; STAT1 |
| Amyotrophic Lateral Sclerosis Signaling | BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3 |
| JAK/Stat Signaling | PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1 |
| Nicotinate and Nicotinamide Metabolism | PRKCE; IRAK1; PRKAA2; EIF2AK2; GRK6; MAPK1; PLK1; AKT2; CDK8; MAPK8; MAPK3; PRKCD; PRKAA1; PBEF1; MAPK9; CDK2; PIM1; DYRK1A; MAP2K2; MAP2K1; PAK3; NT5E; TTK; CSNK1A1; BRAF; SGK |
| Chemokine Signaling | CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPP1CC; MAPK14; NOX1; RAF1; MAP2K2; MAP2K1; JUN; CCL2; PRKCA |
| IL-2 Signaling | ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3 |

TABLE C-continued

| CELLULAR FUNCTION | GENES |
|---|---|
| Synaptic Long Term Depression | PRKCE; IGF1; PRKCZ; PRDX6; LYN; MAPK1; GNAS; PRKCI; GNAQ; PPP2R1A; IGF1R; PRKD1; MAPK3; KRAS; GRN; PRKCD; NOS3; NOS2A; PPP2CA; YWHAZ; RAF1; MAP2K2; PPP2R5C; MAP2K1; PRKCA |
| Estrogen Receptor Signaling | TAF4B; EP300; CARM1; PCAF; MAPK1; NCOR2; SMARCA4; MAPK3; NRIP1; KRAS; SRC; NR3C1; HDAC3; PPARGC1A; RBM9; NCOA3; RAF1; CREBBP; MAP2K2; NCOA2; MAP2K1; PRKDC; ESR1; ESR2 |
| Protein Ubiquitination Pathway | TRAF6; SMURF1; BIRC4; BRCAl; UCHL1; NEDD4; CBL; UBE2I; BTRC; HSPA5; USP7; USP10; FBW7; USP9X; STUB1; USP22; B2M; BIRC2; PARK2; USP8; USP1; VHL; HSP90AA1; BIRC3 |
| IL-10 Signaling | TRAF6; CCR1; ELK1; IKBKB; SP1; FOS; NFKB2; MAP3K14; MAPK8; MAPK13; RELA; MAPK14; TNF; IKBKG; RELB; MAP3K7; JAK1; CHUK; STAT3; NFKB1; JUN; IL1R1; IL6 |
| VDR/RXR Activation | PRKCE; EP300; PRKCZ; RXRA; GADD45A; HES1; NCOR2; SP1; PRKCI; CDKN1B; PRKD1; PRKCD; RUNX2; KLF4; YY1; NCOA3; CDKN1A; NCOA2; SPP1; LRP5; CEBPB; FOXO1; PRKCA |
| TGF-beta Signaling | EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5 |
| Toll-like Receptor Signaling | IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN |
| p38 MAPK Signaling | HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; IL1R1; SRF; STAT1 |
| Neurotrophin/TRK Signaling | NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4 |
| FXR/RXR Activation | INS; PPARA; FASN; RXRA; AKT2; SDC1; MAPK8; APOB; MAPK10; PPARG; MTTP; MAPK9; PPARGC1A; TNF; CREBBP; AKT1; SREBF1; FGFR4; AKT3; FOXO1 |
| Synaptic Long Term Potentiation | PRKCE; RAP1A; EP300; PRKCZ; MAPK1; CREB1; PRKCI; GNAQ; CAMK2A; PRKD1; MAPK3; KRAS; PRKCD; PPP1CC; RAF1; CREBBP; MAP2K2; MAP2K1; ATF4; PRKCA |
| Calcium Signaling | RAP1A; EP300; HDAC4; MAPK1; HDAC5; CREB1; CAMK2A; MYH9; MAPK3; HDAC2; HDAC7A; HDAC11; HDAC9; HDAC3; CREBBP; CALR; CAMKK2; ATF4; HDAC6 |
| EGF Signaling | ELK1; MAPK1; EGFR; PIK3CA; FOS; PIK3CB; PIK3C3; MAPK8; MAPK3; PIK3C2A; RAF1; JAK1; PIK3R1; STAT3; MAP2K1; JUN; PRKCA; SRF; STAT1 |
| Hypoxia Signaling in the Cardiovascular System | EDN1; PTEN; EP300; NQO1; UBE2I; CREB1; ARNT; HIF1A; SLC2A4; NOS3; TP53; LDHA; AKT1; ATM; VEGFA; JUN; ATF4; VHL; HSP90AA1 |
| LPS/IL-1 Mediated Inhibition of RXR Function | IRAK1; MYD88; TRAF6; PPARA; RXRA; ABCA1; MAPK8; ALDH1A1; GSTP1; MAPK9; ABCB1; TRAF2; TLR4; TNF; MAP3K7; NR1H2; SREBF1; JUN; IL1R1 |
| LXR/RXR Activation | FASN; RXRA; NCOR2; ABCA1; NFKB2; IRF3; RELA; NOS2A; TLR4; TNF; RELB; LDLR; NR1H2; NFKB1; SREBF1; IL1R1; CCL2; IL6; MMP9 |
| Amyloid Processing | PRKCE; CSNK1E; MAPK1; CAPNS1; AKT2; CAPN2; CAPN1; MAPK3; MAPK13; MAPT; MAPK14; AKT1; PSEN1; CSNK1A1; GSK3B; AKT3; APP |
| IL-4 Signaling | AKT2; PIK3CA; PIK3CB; PIK3C3; IRS1; KRAS; SOCS1; PTPN6; NR3C1; PIK3C2A; JAK1; AKT1; JAK2; PIK3R1; FRAP1; AKT3; RPS6KB1 |
| Cell Cycle: G2/M DNA Damage Checkpoint Regulation | EP300; PCAF; BRCA1; GADD45A; PLK1; BTRC; CHEK1; ATR; CHEK2; YWHAZ; TP53; CDKN1A; PRKDC; ATM; SFN; CDKN2A |
| Nitric Oxide Signaling in the Cardiovascular System | KDR; FLT1; PGF; AKT2; PIK3CA; PIK3CB; PIK3C3; CAV1; PRKCD; NOS3; PIK3C2A; AKT1; PIK3R1; VEGFA; AKT3; HSP90AA1 |
| Purine Metabolism | NME2; SMARCA4; MYH9; RRM2; ADAR; EIF2AK4; PKM2; ENTPD1; RAD51; RRM2B; TJP2; RAD51C; NT5E; POLD1; NME1 |
| cAMP-mediated Signaling | RAP1A; MAPK1; GNAS; CREB1; CAMK2A; MAPK3; SRC; RAF1; MAP2K2; STAT3; MAP2K1; BRAF; ATF4 |
| Mitochondrial Dysfunction | SOD2; MAPK8; CASP8; MAPK10; MAPK9; CASP9; PARK7; PSEN1; PARK2; APP; CASP3 |
| Notch Signaling | HES1; JAG1; NUMB; NOTCH4; ADAM17; NOTCH2; PSEN1; NOTCH3; NOTCH1; DLL4 |
| Endoplasmic Reticulum Stress Pathway | HSPA5; MAPK8; XBP1; TRAF2; ATF6; CASP9; ATF4; EIF2AK3; CASP3 |
| Pyrimidine Metabolism | NME2; AICDA; RRM2; EIF2AK4; ENTPD1; RRM2B; NT5E; POLD1; NME1 |
| Parkinson's Signaling | UCHL1; MAPK8; MAPK13; MAPK14; CASP9; PARK7; PARK2; CASP3 |
| Cardiac & Beta Adrenergic Signaling | GNAS; GNAQ; PPP2R1A; GNB2L1; PPP2CA; PPP1CC; PPP2R5C |
| Glycolysis/Gluconeogenesis | HK2; GCK; GPI; ALDH1A1; PKM2; LDHA; HK1 |
| Interferon Signaling | IRF1; SOCS1; JAK1; JAK2; IFITM1; STAT1; IFIT3 |
| Sonic Hedgehog Signaling | ARRB2; SMO; GLI2; DYRK1A; GLI1; GSK3B; DYRK1B |
| Glycerophospholipid Metabolism | PLD1; GRN; GPAM; YWHAZ; SPHK1; SPHK2 |
| Phospholipid Degradation | PRDX6; PLD1; GRN; YWHAZ; SPHK1; SPHK2 |
| Tryptophan Metabolism | SIAH2; PRMT5; NEDD4; ALDH1A1; CYP1B1; SIAH1 |
| Lysine Degradation | SUV39H1; EHMT2; NSD1; SETD7; PPP2R5C |
| Nucleotide Excision Repair Pathway | ERCC5; ERCC4; XPA; XPC; ERCC1 |
| Starch and Sucrose Metabolism | UCHL1; HK2; GCK; GPI; HK1 |
| Aminosugars Metabolism | NQO1; HK2; GCK; HK1 |
| Arachidonic Acid Metabolism | PRDX6; GRN; YWHAZ; CYP1B1 |
| Circadian Rhythm Signaling | CSNK1E; CREB1; ATF4; NR1D1 |
| Coagulation System | BDKRB1; F2R; SERPINE1; F3 |
| Dopamine Receptor Signaling | PPP2R1A; PPP2CA; PPP1CC; PPP2R5C |
| Glutathione Metabolism | IDH2; GSTP 1; ANPEP; IDH1 |
| Glycerolipid Metabolism | ALDH1A1; GPAM; SPHK1; SPHK2 |
| Linoleic Acid Metabolism | PRDX6; GRN; YWHAZ; CYP1B1 |
| Methionine Metabolism | DNMT1; DNMT3B; AHCY; DNMT3A |
| Pyruvate Metabolism | GLO1; ALDH1A1; PKM2; LDHA |
| Arginine and Proline Metabolism | ALDH1A1; NOS3; NOS2A |
| Eicosanoid Signaling | PRDX6; GRN; YWHAZ |
| Fructose and Mannose Metabolism | HK2; GCK; HK1 |
| Galactose Metabolism | HK2; GCK; HK1 |
| Stilbene, Coumarine and Lignin Biosynthesis | PRDX6; PRDX1; TYR |
| Antigen Presentation Pathway | CALR; B2M |
| Biosynthesis of Steroids | NQO1; DHCR7 |
| Butanoate Metabolism | ALDH1A1; NLGN1 |
| Citrate Cycle | IDH2; IDH1 |
| Fatty Acid Metabolism | ALDH1A1; CYP1B1 |
| Glycerophospholipid Metabolism | PRDX6; CHKA |

TABLE C-continued

| CELLULAR FUNCTION | GENES |
|---|---|
| Histidine Metabolism | PRMT5; ALDH1A1 |
| Inositol Metabolism | ERO1L; APEX1 |
| Metabolism of Xenobiotics by Cytochrome p450 | GSTP1; CYP1B1 |
| Methane Metabolism | PRDX6; PRDX1 |
| Phenylalanine Metabolism | PRDX6; PRDX1 |
| Propanoate Metabolism | ALDH1A1; LDHA |
| Selenoamino Acid Metabolism | PRMT5; AHCY |
| Sphingolipid Metabolism | SPHK1; SPHK2 |
| Aminophosphonate Metabolism | PRMT5 |
| Androgen and Estrogen Metabolism | PRMT5 |
| Ascorbate and Aldarate Metabolism | ALDH1A1 |
| Bile Acid Biosynthesis | ALDH1A1 |
| Cysteine Metabolism | LDHA |
| Fatty Acid Biosynthesis | FASN |
| Glutamate Receptor Signaling | GNB2L1 |
| NRF2-mediated Oxidative Stress Response | PRDX1 |
| Pentose Phosphate Pathway | GPI |
| Pentose and Glucuronate Interconversions | UCHL1 |
| Retinol Metabolism | ALDH1A1 |
| Riboflavin Metabolism | TYR |
| Tyrosine Metabolism | PRMT5, TYR |
| Ubiquinone Biosynthesis | PRMT5 |
| Valine, Leucine and Isoleucine Degradation | ALDH1A1 |
| Glycine, Serine and Threonine Metabolism | CHKA |
| Lysine Degradation | ALDH1A1 |
| Pain/Taste | TRPM5; TRPA1 |
| Pain | TRPM7; TRPC5; TRPC6; TRPC1; Cnr1; cnr2; Grk2; Trpa1; Pomc; Cgrp; Crf; Pka; Era; Nr2b; TRPM5; Prkaca; Prkacb; Prkar1a; Prkar2a |
| Mitochondrial Function | AIF; CytC; SMAC (Diablo); Aifm-1; Aifm-2 |
| Developmental Neurology | BMP-4; Chordin (Chrd); Noggin (Nog); WNT (Wnt2; Wnt2b; Wnt3a; Wnt4; Wnt5a; Wnt6; Wnt7b; Wnt8b; Wnt9a; Wnt9b; Wnt10a; Wnt10b; Wnt16); beta-catenin; Dkk-1; Frizzled related proteins; Otx-2; Gbx2; FGF-8; Reelin; Dab1; unc-86 (Pou4f1 or Brn3a); Numb; Reln |

Embodiments of the invention also relate to methods and compositions related to knocking out genes, amplifying genes and repairing particular mutations associated with DNA repeat instability and neurological disorders (Robert D. Wells, Tetsuo Ashizawa, Genetic Instabilities and Neurological Diseases, Second Edition, Academic Press, Oct. 13, 2011—Medical). Specific aspects of tandem repeat sequences have been found to be responsible for more than twenty human diseases (New insights into repeat instability: role of RNA•DNA hybrids. McIvor E I, Polak U, Napierala M. RNA Biol. 2010 September-October; 7(5):551-8). The present effector protein systems may be harnessed to correct these defects of genomic instability.

Several further aspects of the invention relate to correcting defects associated with a wide range of genetic diseases which are further described on the website of the National Institutes of Health under the topic subsection Genetic Disorders (website at health.nih.gov/topic/GeneticDisorders). The genetic brain diseases may include but are not limited to Adrenoleukodystrophy, Agenesis of the Corpus Callosum, Aicardi Syndrome, Alpers' Disease, Alzheimer's Disease, Barth Syndrome, Batten Disease, CADASIL, Cerebellar Degeneration, Fabry's Disease, Gerstmann-Straussler-Scheinker Disease, Huntington's Disease and other Triplet Repeat Disorders, Leigh's Disease, Lesch-Nyhan Syndrome, Menkes Disease, Mitochondrial Myopathies and NINDS Colpocephaly. These diseases are further described on the website of the National Institutes of Health under the subsection Genetic Brain Disorders.

Cas9 Development and Use

The present invention may be further illustrated and extended based on aspects of CRISPR-Cas9 development and use as set forth in the following articles and particularly as relates to delivery of a CRISPR protein complex and uses of an RNA guided endonuclease in cells and organisms:

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013);

RNA-guided editing of bacterial genomes using CRISPR-Cas systems. Jiang W., Bikard D., Cox D., Zhang F, Marraffini L A. Nat Biotechnol March; 31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463): 472-6. doi: 10.1038/Nature12466. Epub 2013 Aug. 23 (2013);

Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013);

Genome engineering using the CRISPR-Cas9 system. Ran, F A., Hsu, P D., Wright, J., Agarwala, V., Scott, D A., Zhang, F. Nature Protocols November; 8(11):2281-308 (2013-B);

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013). [Epub ahead of print];

Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure T M, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014(2014);

Development and Applications of CRISPR-Cas9 for Genome Engineering, Hsu P D, Lander E S, Zhang F., Cell. June 5; 157(6):1262-78 (2014).

Genetic screens in human cells using the CRISPR/Cas9 system, Wang T, Wei J J, Sabatini D M, Lander E S., Science. January 3; 343(6166): 80-84. doi:10.1 126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);

Genome-scale transcriptional activation by an engineered CRISPR-Cas9 complex, Konermann S, Brigham M D, Trevino A E, Joung J, Abudayyeh O O, Barcena C, Hsu P D, Habib N, Gootenberg J S, Nishimasu H, Nureki 0, Zhang F., Nature. January 29; 517(7536):583-8 (2015).

A split-Cas9 architecture for inducible genome editing and transcription modulation, Zetsche B, Volz S E, Zhang F., (published online 2 Feb. 2015) Nat Biotechnol. February; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520(7546):186-91 (2015).

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli,* 65% that were recovered contained the mutation.

Wang et al. (2013) used the CRISPR-Cas system for the one-step generation of mice carrying mutations in multiple genes which were traditionally generated in multiple steps by sequential recombination in embryonic stem cells and/or time-consuming intercrossing of mice with a single mutation. The CRISPR-Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and gRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

The present invention may be further illustrated and extended based on aspects of CRISPR-Cas9 development and use as set forth in the following articles and particularly as relates to delivery of a CRISPR protein complex and uses of an RNA guided endonuclease in cells and organisms and delivery of such components, including methods, materials, delivery vehicles, vectors, particles, AAV, and making and using thereof, including as to amounts and formulations, all useful in the practice of the instant invention, reference is made to: PCT Patent Publications PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809).

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference. The present invention will be further illustrated in the following Examples which are given for illustration purposes only and are not intended to limit the invention in any way.

EXAMPLES

Gene ID: H; Gene Type: Cpf1; Organism: *Francisella ularensis* subsp. *novicida* U112; Spacer Length—mode (range): 31; DR1:

(SEQ ID NO: 49)
GUCUAAGAACUUUAAAUAAUUUCUACUGUUGUAGAU;;

DR2: none;; Protein Sequence:

(SEQ ID NO: 51)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIDRGERHLAYYTLVDGKGNIIKQDTFNIIGNDRMK

TNYHDKLAAIEKDRDSARKDWKKINNIKEMKEGYLSQVVHEIAKLVIEYN

AIVVFEDLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDADANGAYHIGLKGLMLLGRIKNNQEGKKLNLVIKNEEYFEFVQNRNN

Genes for Synthesis

For gene H, optimize for human expression and append the following DNA sequence to the end of each gene. Note this DNA sequence contains a stop codon (underlined), so do not add any stop codon to the codon optimized gene sequence:

(SEQ ID NO: 52)
AAAAGGCCGGCGGCCACGAAAAAGGCCGGCCAGGCAAAAAGAAAAAGgg atccTACCCATACGATGTTCCAGATTACGCTTATCCCTACGACGTGCCTG

ATTATGCATACCCATATGATGTCCCCGACTATGCCTAA

For optimization, avoid the following restriction sites: BamHI, EcoRI, HindIII, BsmBI, BsaI, BbsI, AgeI, XhoI, NdeI, NotI, KpnI, BsrGI, SpeI, XbaI, NheI Example 3: Further evaluation of Cpf1 and associated components Applicants carried out sequence alignments with Cas-Cpf1 orthologs and compared the domain structure and organization (FIG. 1 A-N). An overview of Cpf1 loci alignment in shown in FIG. 2.

The sequences of Cpf1 loci in various orthologs are listed below:

```
>KKP36646_(modified) hypothetical protein UR27_C0015G0004
[Peregrinibacteria bacterium GW2011_GWA2_33_10]
                                                  (SEQ ID NO: 68)
MSNFFKNFTNLYELSKTLRFELKPVGDTLTNMKDHLEYDEKLQTFLKDQNIDDAYQAL

KPQFDEIHEEFITDSLESKKAKEIDFSEYLDLFQEKKELNDSEKKLRNKIGETFNKAGEKW

KKEKYPQYEWKKGSKIANGADILSCQDMLQFIKYKNPEDEKIKNYIDDTLKGFFTYFGG

FNQNRANYYETKKEASTAVATRIVHENLPKFCDNVIQFKHIIKRKKDGTVEKTERKTEY

LNAYQYLKNNNKITQIKDAETEKMIESTPIAEKIFDVYYFSSCLSQKQIEEYNRIIGHYNLL

INLYNQAKRSEGKHLSANEKKYKDLPKFKTLYKQIGCGKKKDLFYTIKCDTEEEANKSR

NEGKESHSVEEIINKAQEAINKYFKSNNDCENINTVPDFINYILTKENYEGVYWSKAAMN

TISDKYFANYHDLQDRLKEAKVFQKADKKSEDDIKIPEAIELSGLFGVLDSLADWQTTLF

KSSILSNEDKLKIITDSQTPSEALLKMIFNDIEKNMESFLKETNDIITLKKYKGNKEGTEKI

KQWFDYTLAINRMLKYFLVKENKIKGNSLDTNISEALKTLIYSDDAEWFKWYDALRNY
```

```
LTQKPQDEAKENKLKLNFDNPSLAGGWDVNKECSNFCVILKDKNEKKYLAIMKKGENT

LFQKEWTEGRGKNLTKKSNPLFEINNCEILSKMEYDFWADVSKMIPKCSTQLKAVVNHF

KQSDNEFIFPIGYKVTSGEKFREECKISKQDFELNNKVFNKNELSVTAMRYDLSSTQEKQ

YIKAFQKEYWELLFKQEKRDTKLTNNEIFNEWINFCNKKYSELLSWERKYKDALTNWIN

FCKYFLSKYPKTTLFNYSFKESENYNSLDEFYRDVDICSYKLNINTTINKSILDRLVEEGK

LYLFEIKNQDSNDGKSIGHKNNLHTIYWNAIFENFDNRPKLNGEAEIFYRKAISKDKLGIV

KGKKTKNGTEIIKNYRFSKEKFILHVPITLNFCSNNEYVNDIVNTKFYNFSNLHFLGIDRG

EKHLAYYSLVNKNGEIVDQGTLNLPFTDKDGNQRSIKKEKYFYNKQEDKWEAKEVDC

WNYNDLLDAMASNRDMARKNWQRIGTIKEAKNGYVSLVIRKIADLAVNNERPAFIVLE

DLNTGFKRSRQKIDKSVYQKFELALAKKLNFLVDKNAKRDEIGSPTKALQLTPPVNNYG

DIENKKQAGIMLYTRANYTSQTDPATGWRKTIYLKAGPEETTYKKDGKIKNKSVKDQII

ETFTDIGFDGKDYYFEYDKGEFVDEKTGEIKPKKWRLYSGENGKSLDRFRGEREKDKYE

WKIDKIDIVKILDDLFVNFDKNISLLKQLKEGVELTRNNEHGTGESLRFAINLIQQIRNTG

NNERDNDFILSPVRDENGKHFDSREYWDKETKGEKISMPSSGDANGAFNIARKGIIMNA

HILANSDSKDLSLFVSDEEWDLHLNNKTEWKKQLNIFSSRKAMAKRKK

>KKR91555_(modified) hypothetical protein UU43_C0004G0003
[Parcubacteria (Falkowbacteria) bacterium GW2011_GWA2_41_14]
                                               (SEQ ID NO: 69)
MLFFMSTDITNKPREKGVFDNFTNLYEFSKTLTFGLIPLKWDDNKKMIVEDEDFSVLRK

YGVIEEDKRIAESIKIAKFYLNILHRELIGKVLGSLKFEKKNLENYDRLLGEIEKNNKNENI

SEDKKKEIRKNFKKELSIAQDILLKKVGEVFESNGSGILSSKNCLDELTKRFTRQEVDKLR

RENKDIGVEYPDVAYREKDGKEETKSFFAMDVGYLDDFHKNRKQLYSVKGKKNSLGR

RILDNFEIFCKNKKLYEKYKNLDIDFSEIERNFNLTLEKVFDFDNYNERLTQEGLDEYAKI

LGGESNKQERTANIHGLNQIINLYIQKKQSEQKAEQKETGKKKIKFNKKDYPTFTCLQKQ

ILSQVFRKEIIIESDRDLIRELKFFVEESKEKVDKARGIIEFLLNHEENDIDLAMVYLPKSKI

NSFVYKVFKEPQDFLSVFQDGASNLDFVSFDKIKTHLENNKLTYKIFFKTLIKENHDFESF

LILLQQEIDLLIDGGETVTLGGKKESITSLDEKKNRLKEKLGWFEGKVRENEKMKDEEEG

EFCSTVLAYSQAVLNITKRAEIFWLNEKQDAKVGEDNKDMIFYKKFDEFADDGFAPFFY

FDKFGNYLKRRSRNTTKEIKLHFGNDDLLEGWDMNKEPEYWSFILRDRNQYYLGIGKK

DGEIPHKKLGNSVEAVKEAYELENEADFYEKIDYKQLNIDRFEGIAFPKKTKTEEAFRQV

CKKRADEFLGGDTYEFKILLAIKKEYDDFKARRQKEKDWDSKFSKEKMSKLIEYYITCL

GKRDDWKRFNLNFRQPKEYEDRSDFVRHIQRQAYWIDPRKVSKDYVDKKVAEGEMFL

FKVHNKDFYDFERKSEDKKNHTANLFTQYLLELFSCENIKNIKSKDLIESIFELDGKAEIR

FRPKTDDVKLKIYQKKGKDVTYADKRDGNKEKEVIQHRRFAKDALTLHLKIRLNFGKH

VNLFDFNKLVNTELFAKVPVKILGMDRGENNLIYYCFLDEHGEIENGKCGSLNRVGEQII

TLEDDKKVKEPVDYFQLLVDREGQRDWEQKNWQKMTRIKDLKKAYLGNVVSWISKE

MLSGIKEGVVTIGVLEDLNSNFKRTRFFRERQVYQGFEKALVNKLGYLVDKKYDNYRN

VYQFAPIVDSVEEMEKNKQIGTLVYVPASYTSKICPHPKCGWRERLYMKNSASKEKIVG

LLKSDGIKISYDQKNDRFYFEYQWEQEHKSDGKKKKYSGVDKVFSNVSRMRWDVEQK

KSIDFVDGTDGSITNKLKSLLKGKGIELDNINQQIVNQQKELGVEFFQSIIFYFNLIMQIRN

YDKEKSGSEADYIQCPSCLFDSRKPEMNGKLSAITNGDANGAYNIARKGFMQLCRIREN

PQEPMKLITNREWDEAVREWDIYSAAQKIPVLSEEN
```

>KDN25524_(modified) hypothetical protein MBO_03467
[*Moraxella bovoculi* 237]

(SEQ ID NO: 70)

MLFQDFTHLYPLSKTVRFELKPIDRTLEHIHAKNFLSQDETMADMHQKVKVILDDYHRD

FIADMMGEVKLTKLAEFYDVYLKFRKNPKDDELQKQLKDLQAVLRKEIVKPIGNGGKY

KAGYDRLFGAKLFKDGKELGDLAKFVIAQEGESSPKLAHLAHFEKFSTYFTGFHDNRKN

MYSDEDKHTAIAYRLIHENLPRFIDNLQILTTIKQKHSALYDQIINELTASGLDVSLASHL

DGYHKLLTQEGITAYNTLLGGISGEAGSPKIQGINELINSHHNQHCHKSERIAKLRPLHKQ

ILSDGMSVSFLPSKFADDSEMCQAVNEFYRHYADVFAKVQSLFDGFDDHQKDGIYVEH

KNLNELSKQAFGDFALLGRVLDGYYVDVVNPEFNERFAKAKTDNAKAKLTKEKDKFIK

GVHSLASLEQAIEHYTARHDDESVQAGKLGQYFKHGLAGVDNPIQKIHNNHSTIKGFLE

RERPAGERALPKIKSGKNPEMTQLRQLKELLDNALNVAHFAKLLTTKTTLDNQDGNFY

GEFGVLYDELAKIPTLYNKVRDYLSQKPFSTEKYKLNFGNPTLLNGWDLNKEKDNFGVI

LQKDGCYYLALLDKAHKKVFDNAPNTGKSIYQKMIYKYLEVRKQFPKVFFSKEAIAINY

HPSKELVEIKDKGRQRSDDERLKLYRFILECLKIHPKYDKKFEGAIGDIQLFKKDKKGRE

VPISEKDLFDKINGIFSSKPKLEMEDFFIGEFKRYNPSQDLVDQYNIYKKIDSNDNRKKEN

FYNNHPKFKKDLVRYYYESMCKHEEWEESFEFSKKLQDIGCYVDVNELFTEIETRRLNY

KISFCNINADYIDELVEQGQLYLFQIYNKDFSPKAHGKPNLHTLYFKALFSEDNLADPIY

KLNGEAQIFYRKASLDMNETTIHRAGEVLENKNPDNPKKRQFVYDIIKDKRYTQDKFML

HVPITMNFGVQGMTIKEFNKKVNQSIQQYDEVNVIGIDRGERHLLYLTVINSKGEILEQC

SLNDITTASANGTQMTTPYHKILDKREIERLNARVGWGEIETIKELKSGYLSHVVHQISQ

LMLKYNAIVVLEDLNFGFKRGRFKVEKQIYQNFENALIKKLNHLVLKDKADDEIGSYKN

ALQLTNNFTDLKSIGKQTGFLFYVPAWNTSKIDPETGFVDLLKPRYENIAQSQAFFGKFD

KICYNADKDYFEFHIDYAKFTDKAKNSRQIWTICSHGDKRYVYDKTANQNKGAAKGIN

VNDELKSLFARHHINEKQPNLVMDICQNNDKEFHKSLMYLLKTLLALRYSNASSDEDFI

LSPVANDEGVFFNSALADDTQPQNADANGAYHIALKGLWLLNELKNSDDLNKVKLAID

NQTWLNFAQNR

>KKT48220_(modified) hypothetical protein UW39_C0001G0044
[*Parcubacteria bacterium* GW2011_GWC2_44_17]

(SEQ ID NO: 71)

MENIFDQFIGKYSLSKTLRFELKPVGKTEDFLKINKVFEKDQTIDDSYNQAKFYFDSLHQ

KFIDAALASDKTSELSFQNFADVLEKQNKIILDKKREMGALRKRDKNAVGIDRLQKEIN

DAEDIIQKEKEKIYKDVRTLFDNEAESWKTYYQEREVDGKKITFSKADLKQKGADFLTA

AGILKVLKYEFPEEKEKEFQAKNQPSLFVEEKENPGQKRYIFDSFDKFAGYLTKFQQTKK

NLYAADGTSTAVATRIADNFIIFHQNTKVFRDKYKNNHTDLGFDEENIFEIERYKNCLLQ

REIEHIKNENSYNKIIGRINKKIKEYRDQKAKDTKLTKSDFPFFKNLDKQILGEVEKEKQL

IEKTREKTEEDVLIERFKEFIENNEERFTAAKKLMNAFCNGEFESEYEGIYLKNKAINTISR

RWFVSDRDFELKLPQQKSKNKSEKNEPKVKKFISIAEIKNAVEELDGDIFKAVFYDKKII

AQGGSKLEQFLVIWKYEFEYLFRDIERENGEKLLGYDSCLKIAKQLGIFPQEKEAREKAT

AVIKNYADAGLGIFQMMKYFSLDDKDRKNTPGQLSTNFYAEYDGYYKDFEFIKYYNEF

RNFITKKPFDEDKIKLNFENGALLKGWDENKEYDFMGVILKKEGRLYLGIMHKNHRKLF

QSMGNAKGDNANRYQKMIYKQIADASKDVPRLLLTSKKAMEKFKPSQEILRIKKEKTF

KRESKNFSLRDLHALIEYYRNCIPQYSNWSFYDFQFQDTGKYQNIKEFTDDVQKYGYKI

SFRDIDDEYINQALNEGKMYLFEVVNKDIYNTKNGSKNLHTLYFEHILSAENLNDPVFKL

```
SGMAEIFQRQPSVNEREKITTQKNQCILDKGDRAYKYRRYTEKKIMFHMSLVLNTGKGE

IKQVQFNKIINQRISSSDNEMRVNVIGIDRGEKNLLYYSVVKQNGEIIEQASLNEINGVNY

RDKLIEREKERLKNRQSWKPVVKIKDLKKGYISHVIHKICQLIEKYSAIVVLEDLNMRFK

QIRGGIERSVYQQFEKALIDKLGYLVFKDNRDLRAPGGVLNGYQLSAPFVSFEKMRKQT

GILFYTQAEYTSKTDPITGFRKNVYISNSASLDKIKEAVKKFDAIGWDGKEQSYFFKYNP

YNLADEKYKNSTVSKEWAIFASAPRIRRQKGEDGYWKYDRVKVNEEFEKLLKVWNFV

NPKATDIKQEIIKKEKAGDLQGEKELDGRLRNFWHSFIYLFNLVLELRNSFSLQIKIKAGE

VIAVDEGVDFIASPVKPFFTTPNPYIPSNLCWLAVENADANGAYNIARKGVMILKKIREH

AKKDPEFKKLPNLFISNAEWDEAARDWGKYAGTTALNLDH
```

>WP_031492824_(modified) hypothetical protein [*Succinivibrio dextrinosolvens*]

(SEQ ID NO: 72)

```
MSSLTKFTNKYSKQLTIKNELIPVGKTLENIKENGLIDGDEQLNENYQKAKIIVDDFLRDF

INKALNNTQIGNWRELADALNKEDEDNIEKLQDKIRGIIVSKFETFDLFSSYSIKKDEKIID

DDNDVEEEELDLGKKTSSFKYIFKKNLFKLVLPSYLKTTNQDKLKIISSFDNFSTYFRGFF

ENRKNIFTKKPISTSIAYRIVHDNFPKFLDNIRCFNVWQTECPQLIVKADNYLKSKNVIAK

DKSLANYFTVGAYDYFLSQNGIDFYNNIIGGLPAFAGHEKIQGLNEFINQECQKDSELKS

KLKNRHAFKMAVLFKQILSDREKSFVIDEFESDAQVIDAVKNFYAEQCKDNNVIFNLLN

LIKNIAFLSDDELDGIFIEGKYLSSVSQKLYSDWSKLRNDIEDSANSKQGNKELAKKIKTN

KGDVEKAISKYEFSLSELNSIVHDNTKFSDLLSCTLHKVASEKLVKVNEGDWPKHLKNN

EEKQKIKEPLDALLEIYNTLLIFNCKSFNKNGNFYVDYDRCINELSSVVYLYNKTRNYCT

KKPYNTDKFKLNFNSPQLGEGFSKSKENDCLTLLFKKDDNYYVGIIRKGAKINFDDTQAI

ADNTDNCIFKMNYFLLKDAKKFIPKCSIQLKEVKAHFKKSEDDYILSDKEKFASPLVIKK

STFLLATAHVKGKKGNIKKFQKEYSKENPTEYRNSLNEWIAFCKEFLKTYKAATIFDITT

LKKAEEYADIVEFYKDVDNLCYKLEFCPIKTSFIENLIDNGDLYLFRINNKDFSSKSTGTK

NLHTLYLQAIFDERNLNNPTIMLNGGAELFYRKESIEQKNRITHKAGSILVNKVCKDGTS

LDDKIRNEIYQYENKFIDTLSDEAKKVLPNVIKKEATHDITKDKRFTSDKFFFHCPLTINY

KEGDTKQFNNEVLSFLRGNPDINIIGIDRGERNLIYVTVINQKGEILDSVSFNTVTNKSSKI

EQTVDYEEKLAVREKERIEAKRSWDSISKIATLKEGYLSAIVHEICLLMIKHNAIVVLENL

NAGFKRIRGGLSEKSVYQKFEKMLINKLNYFVSKKESDWNKPSGLLNGLQLSDQFESFE

KLGIQSGFIFYVPAAYTSKIDPTTGFANVLNLSKVRNVDAIKSFFSNFNEISYSKKEALFKF

SFDLDSLSKKGFSSFVKFSKSKWNVYTFGERIIKPKNKQGYREDKRINLTFEMKKLLNEY

KVSFDLENNLIPNLTSANLKDTFWKELFFIFKTTLQLRNSVTNGKEDVLISPVKNAKGEF

FVSGTHNKTLPQDCDANGAYHIALKGLMILERNNLVREEKDTKKIMAISNVDWFEYVQ

KRRGVL
```

>KKT50231_(modified) hypothetical protein UW40_C0007G0006 [*Parcubacteria bacterium* GW2011_GWF2_44_17]

(SEQ ID NO: 73)

```
MKPVGKTEDFLKINKVFEKDQTIDDSYNQAKFYFDSLHQKFIDAALASDKTSELSFQNF

ADVLEKQNKIILDKKREMGALRKRDKNAVGIDRLQKEINDAEDIIQKEKEKIYKDVRTLF

DNEAESWKTYYQEREVDGKKITFSKADLKQGADFLTAAGILKVLKYEFPEEKEKEFQ

AKNQPSLFVEEKENPGQKRYIFDSFDKFAGYLTKFQQTKKNLYAADGTSTAVATRIADN

FIIFHQNTKVFRDKYKNNHTDLGFDEENIFEIERYKNCLLQREIEHIKNENSYNKIIGRINK
```

-continued

KIKEYRDQKAKDTKLTKSDFPFFKNLDKQILGEVEKEKQLIEKTREKTEEDVLIERFKEFI

ENNEERFTAAKKLMNAFCNGEFESEYEGIYLKNKAINTISRRWFVSDRDFELKLPQQKS

KNKSEKNEPKVKKFISIAEIKNAVEELDGDIFKAVFYDKKIIAQGGSKLEQFLVIWKYEFE

YLFRDIERENGEKLLGYDSCLKIAKQLGIFPQEKEAREKATAVIKNYADAGLGIFQMMK

YFSLDDKDRKNTPGQLSTNFYAEYDGYYKDFEFIKYYNEFRNFITKKPFDEDKIKLNFEN

GALLKGWDENKEYDFMGVILKKEGRLYLGIMHKNHRKLFQSMGNAKGDNANRYQKM

IYKQIADASKDVPRLLLTSKKAMEKFKPSQEILRIKKEKTFKRESKNFSLRDLHALIEYYR

NCIPQYSNWSFYDFQFQDTGKYQNIKEFTDDVQKYGYKISFRDIDDEYINQALNEGKMY

LFEVVNKDIYNTKNGSKNLHTLYFEHILSAENLNDPVFKLSGMAEIFQRQPSVNEREKIT

TQKNQCILDKGDRAYKYRRYTEKKIMFHMSLVLNTGKGEIKQVQFNKIINQRISSSDNE

MRVNVIGIDRGEKNLLYYSVVKQNGEIIEQASLNEINGVNYRDKLIEREKERLKNRQSW

KPVVKIKDLKKGYISHVIHKICQLIEKYSAIVVLEDLNMRFKQIRGGIERSVYQQFEKALI

DKLGYLVFKDNRDLRAPGGVLNGYQLSAPFVSFEKMRKQTGILFYTQAEYTSKTDPITG

FRKNVYISNSASLDKIKEAVKKFDAIGWDGKEQSYFFKYNPYNLADEKYKNSTVSKEW

AIFASAPRIRRQKGEDGYWKYDRVKVNEEFEKLLKVWNFVNPKATDIKQEIIKKEKAGD

LQGEKELDGRLRNFWHSFIYLFNLVLELRNSFSLQIKIKAGEVIAVDEGVDFIASPVKPFF

TTPNPYIPSNLCWLAVENADANGAYNIARKGVMILKKIREHAKKDPEFKKLPNLFISNAE

WDEAARDWGKYAGTTALNLDH

>WP_004356401_(modified) hypothetical protein [Prevotella disiens]

(SEQ ID NO: 74)

MENYQEFTNLFQLNKTLRFELKPIGKTCELLEEGKIFASGSFLEKDKVRADNVSYVKKEI

DKKHKIFIEETLSSFSISNDLLKQYFDCYNELKAFKKDCKSDEEEVKKTALRNKCTSIQR

AMREAISQAFLKSPQKKLLAIKNLIENVFKADENVQHFSEFTSYFSGFETNRENFYSDEE

KSTSIAYRLVHDNLPIFIKNIYIFEKLKEQFDAKTLSEIFENYKLYVAGSSLDEVFSLEYFN

NTLTQKGIDNYNAVIGKIVKEDKQEIQGLNEHINLYNQKHKDRRLPFFISLKKQILSDREA

LSWLPDMFKNDSEVIKALKGFYIEDGFENNVLTPLATLLSSLDKYNLNGIFIRNNEALSSL

SQNVYRNFSIDEAIDANAELQTFNNYELIANALRAKIKKETKQGRKSFEKYEEYIDKKVK

AIDSLSIQEINELVENYVSEFNSNSGNMPRKVEDYFSLMRKGDFGSNDLIENIKTKLSAAE

KLLGTKYQETAKDIFKKDENSKLIKELLDATKQFQHFIKPLLGTGEEADRDLVFYGDFLP

LYEKFEELTLLYNKVRNRLTQKPYSKDKIRLCFNKPKLMTGWVDSKTEKSDNGTQYGG

YLFRKKNEIGEYDYFLGISSKAQLFRKNEAVIGDYERLDYYQPKANTIYGSAYEGENSY

KEDKKRLNKVIIAYIEQIKQTNIKKSIIESISKYPNISDDDKVTPSSLLEKIKKVSIDSYNGIL

SFKSFQSVNKEVIDNLLKTISPLKNKAEFLDLINKDYQIFTEVQAVIDEICKQKTFIYFPISN

VELEKEMGDKDKPLCLFQISNKDLSFAKTFSANLRKKRGAENLHTMLFKALMEGNQDN

LDLGSGAIFYRAKSLDGNKPTHPANEAIKCRNVANKDKVSLFTYDIYKNRRYMENKFLF

HLSIVQNYKAANDSAQLNSSATEYIRKADDLHIIGIDRGERNLLYYSVIDMKGNIVEQDS

LNIIRNNDLETDYHDLLDKREKERKANRQNWEAVEGIKDLKKGYLSQAVHQIAQLMLK

YNAIIALEDLGQMFVTRGQKIEKAVYQQFEKSLVDKLSYLVDKKRPYNELGGILKAYQL

ASSITKNNSDKQNGFLFYVPAWNTSKIDPVTGFTDLLRPKAMTIKEAQDFFGAFDNISYN

DKGYFEFETNYDKFKIRMKSAQTRWTICTFGNRIKRKKDKNYWNYEEVELTEEFKKLF

KDSNIDYENCNLKEEIQNKDNRKFFDDLIKLLQLTLQMRNSDDKGNDYIISPVANAEGQF

-continued

FDSRNGDKKLPLDADANGAYNIARKGLWNIRQIKQTKNDKKLNLSISSTEWLDFVREKP

YLK

>CCB70584_(modified) Protein of unknown function
[*Flavobacterium branchiophilum* FL-15]
(SEQ ID NO: 75)

MTNKFTNQYSLSKTLRFELIPQGKTLEFIQEKGLLSQDKQRAESYQEMKKTIDKFHKYFI

DLALSNAKLTHLETYLELYNKSAETKKEQKFKDDLKKVQDNLRKEIVKSFSDGDAKSIF

AILDKKELITVELEKWFENNEQKDIYFDEKFKTFTTYFTGFHQNRKNMYSVEPNSTAIAY

RLIHENLPKFLENAKAFEKIKQVESLQVNFRELMGEFGDEGLIFVNELEEMFQINYYNDV

LSQNGITIYNSIISGFTKNDIKYKGLNEYINNYNQTKDKKDRLPKLKQLYKQILSDRISLSF

LPDAFTDGKQVLKAIFDFYKINLLSYTIEGQEESQNLLLLIRQTIENLSSFDTQKIYLKNDT

HLTTISQQVFGDFSVFSTALNYWYETKVNPKFETEYSKANEKKREILDKAKAVFTKQDY

FSIAFLQEVLSEYILTLDHTSDIVKKHSSNCIADYFKNHFVAKKENETDKTFDFIANITAK

YQCIQGILENADQYEDELKQDQKLIDNLKFFLDAILELLHFIKPLHLKSESITEKDTAFYD

VFENYYEALSLLTPLYNMVRNYVTQKPYSTEKIKLNFENAQLLNGWDANKEGDYLTTI

LKKDGNYFLAIMDKKHNKAFQKFPEGKENYEKMVYKLLPGVNKMLPKVFFSNKNIAY

FNPSKELLENYKKETHKKGDTFNLEHCHTLIDFFKDSLNKHEDWKYFDFQFSETKSYQD

LSGFYREVEHQGYKINFKNIDSEYIDGLVNEGKLFLFQIYSKDFSPFSKGKPNMHTLYWK

ALFEEQNLQNVIYKLNGQAEIFFRKASIKPKNIILHKKKIKIAKKHFIDKKTKTSEIVPVQTI

KNLNMYYQGKISEKELTQDDLRYIDNFSIFNEKNKTIDIIKDKRFTVDKFQFHVPITMNFK

ATGGSYINQTVLEYLQNNPEVKIIGLDRGERHLVYLTLIDQQGNILKQESLNTITDSKISTP

YHKLLDNKENERDLARKNWGTVENIKELKEGYISQVVHKIATLMLEENAIVVMEDLNF

GFKRGRFKVEKQIYQKLEKMLIDKLNYLVLKDKQPQELGGLYNALQLTNKFESFQKMG

KQSGFLFYVPAWNTSKIDPTTGFVNYFYTKYENVDKAKAFFEKFEAIRFNAEKKYFEFE

VKKYSDFNPKAEGTQQAWTICTYGERIETKRQKDQNNKFVSTPINLTEKIEDFLGKNQIV

YGDGNCIKSQIASKDDKAFFETLLYWFKMTLQMRNSETRTDIDYLISPVMNDNGTFYNS

RDYEKLENPTLPKDADANGAYHIAKKGLMLLNKIDQADLTKKVDLSISNRDWLQFVQK

NK

>WP_005398606_(modified) hypothetical protein
[*Helcococcus kunzii*]
(SEQ ID NO: 76)

MFEKLSNIVSISKTIRFKLIPVGKTLENIEKLGKLEKDFERSDFYPILKNISDDYYRQYIKEK

LSDLNLDWQKLYDAHELLDSSKKESQKNLEMIQAQYRKVLFNILSGELDKSGEKNSKD

LIKNNKALYGKLFKKQFILEVLPDFVNNNDSYSEEDLEGLNLYSKFTTRLKNFWETRKN

VFTDKDIVTAIPFRAVNENFGFYYDNIKIFNKNIEYLENKIPNLENELKEADILDDNRSVK

DYFTPNGFNYVITQDGIDVYQAIRGGFTKENGEKVQGINEILNLTQQQLRRKPETKNVKL

GVLTKLRKQILEYSESTSFLIDQIEDDNDLVDRINKFNVSFFESTEVSPSLFEQIERLYNAL

KSIKKEEVYIDARNTQKFSQMLFGQWDVIRRGYTVKITEGSKEEKKKYKEYLELDETSK

AKRYLNIREIEELVNLVEGFEEVDVFSVLLEKFKMNNIERSEFEAPIYGSPIKLEAIKEYLE

KHLEEYHKWKLLLIGNDDLDTDETFYPLLNEVISDYYIIPLYNLTRNYLTRKHSDKDKIK

VNFDFPTLADGWSESKISDNRSIILRKGGYYYLGILIDNKLLINKKNKSKKIYEILIYNQIPE

FSKSIPNYPFTKKVKEHFKNNVSDFQLIDGYVSPLIITKEIYDIKKEKKYKKDFYKDNNTN

KNYLYTIYKWIEFCKQFLYKYKGPNKESYKEMYDFSTLKDTSLYVNLNDFYADVNSCA

YRVLFNKIDENTIDNAVEDGKLLLFQIYNKDFSPESKGKKNLHTLYWLSMFSEENLRTR

-continued

KLKLNGQAEIFYRKKLEKKPIIHKEGSILLNKIDKEGNTIPENIYHECYRYLNKKIGREDLS

DEAIALFNKDVLKYKEARFDIIKDRRYSESQFFFHVPITFNWDIKTNKNVNQIVQGMIKD

GEIKHIIGIDRGERHLLYYSVIDLEGNIVEQGSLNTLEQNRFDNSTVKVDYQNKLRTREED

RDRARKNWTNINKIKELKDGYLSHVVHKLSRLIIKYEAIVIMENLNQGFKRGRFKVERQ

VYQKFELALMNKLSALSFKEKYDERKNLEPSGILNPIQACYPVDAYQELQGQNGIVFYL

PAAYTSVIDPVTGFTNLFRLKSINSSKYEEFIKKFKNIYFDNEEEDFKFIFNYKDFAKANL

VILNNIKSKDWKISTRGERISYNSKKKEYFYVQPTEFLINKLKELNIDYENIDIIPLIDNLEE

KAKRKILKALFDTFKYSVQLRNYDFENDYIISPTADDNGNYYNSNEIDIDKTNLPNNGDA

NGAFNIARKGLLLKDRIVNSNESKVDLKIKNEDWINFIIS

>WP_021736722_(modified) CRISPR-associated protein Cpf1, subtype PREFRAN [*Acidaminococcus* sp. BV3L6]

(SEQ ID NO: 77)

MTQFEGFTNLYQVSKTLRFELIPQGKTLKHIQEQGFIEEDKARNDHYKELKPIIDRIYKTY

ADQCLQLVQLDWENLSAAIDSYRKEKTEETRNALIEEQATYRNAIHDYFIGRTDNLTDAI

NKRHAEIYKGLFKAELFNGKVLKQLGTVTTTEHENALLRSFDKFTTYFSGFYENRKNVF

SAEDISTAIPHRIVQDNFPKFKENCHIFTRLITAVPSLREHFENVKKAIGIFVSTSIEEVFSFP

FYNQLLTQTQIDLYNQLLGGISREAGTEKIKGLNEVLNLAIQKNDETAHIIASLPHRFIPLF

KQILSDRNTLSFILEEFKSDEEVIQSFCKYKTLLRNENVLETAEALFNELNSIDLTHIFISHK

KLETISSALCDHWDTLRNALYERRISELTGKITKSAKEKVQRSLKHEDINLQEIISAAGKE

LSEAFKQKTSEILSHAHAALDQPLPTTLKKQEEKEILKSQLDSLLGLYHLLDWFAVDESN

EVDPEFSARLTGIKLEMEPSLSFYNKARNYATKKPYSVEKFKLNFQMPTLASGWDVNKE

KNNGAILFVKNGLYYLGIMPKQKGRYKALSFEPTEKTSEGFDKMYYDYFPDAAKMIPK

CSTQLKAVTAHFQTHTTPILLSNNFIEPLEITKEIYDLNNPEKEPKKFQTAYAKKTGDQKG

YREALCKWIDFTRDFLSKYTKTTSIDLSSLRPSSQYKDLGEYYAELNPLLYHISFQRIAEK

EIMDAVETGKLYLFQIYNKDFAKGHHGKPNLHTLYWTGLFSPENLAKTSIKLNGQAELF

YRPKSRMKRMAHRLGEKMLNKKLKDQKTPIPDTLYQELYDYVNHRLSHDLSDEARAL

LPNVITKEVSHEIIKDRRFTSDKFFFHVPITLNYQAANSPSKFNQRVNAYLKEHPETPIIGI

DRGERNLIYITVIDSTGKILEQRSLNTIQQFDYQKKLDNREKERVAARQAWSVVGTIKDL

KQGYLSQVIHEIVDLMIHYQAVVVLENLNFGFKSKRTGIAEKAVYQQFEKMLIDKLNCL

VLKDYPAEKVGGVLNPYQLTDQFTSFAKMGTQSGFLFYVPAPYTSKIDPLTGFVDPFVW

KTIKNHESRKHFLEGFDFLHYDVKTGDFILHFKMNRNLSFQRGLPGFMPAWDIVFEKNE

TQFDAKGTPFIAGKRIVPVIENHRFTGRYRDLYPANELIALLEEKGIVFRDGSNILPKLLEN

DDSHAIDTMVALIRSVLQMRNSNAATGEDYINSPVRDLNGVCFDSRFQNPEWPMDADA

NGAYHIALKGQLLLNHLKESKDLKLQNGISNQDWLAYIQELRN

>WP_004339290_(modified) hypothetical protein [*Francisella tularensis*]

(SEQ ID NO: 78)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISKYINDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

-continued

VEEKSIKETLSLLFDDLKAQKLDLSKIYFKNDKSLTDLSQQVFDDYSVIGTAVLEYITQQ

VAPKNLDNPSKKEQDLIAKKTEKAKYLSLETIKLALEEFNKHRDIDKQCRFEEILSNFAAI

PMIFDEIAQNKDNLAQISIKYQNQGKKDLLQASAEEDVKAIKDLLDQTNNLLHRLKIFHI

SQSEDKANILDKDEHFYLVFEECYFELANIVPLYNKIRNYITQKPYSDEKFKLNFENSTLA

SGWDKNKESANTAILFIKDDKYYLGIMDKKHNKIFSDKAIEENKGEGYKKIVYKQIADA

SKDIQNLMIIDGKTVCKKGRKDRNGVNRQLLSLKRKHLPENIYRIKETKSYLKNEARFSR

KDLYDFIDYYKDRLDYYDFEFELKPSNEYSDFNDFTNHIGSQGYKLTFENISQDYINSLV

NEGKLYLFQIYSKDFSAYSKGRPNLHTLYWKALFDERNLQDVVYKLNGEAELFYRKQSI

PKKITHPAKETIANKNKDNPKKESVFEYDLIKDKRFTEDKFFFHCPITINFKSSGANKFND

EINLLLKEKANDVHILSIDRGERHLAYYTLVDGKGNIIKQDNFNIIGNDRMKTNYHDKLA

AIEKDRDSARKDWKKINNIKEMKEGYLSQVVHEIAKLVIEYNAIVVFEDLNFGFKRGRF

KVEKQVYQKLEKMLIEKLNYLVFKDNEFDKTGGVLRAYQLTAPFETFKKMGKQTGITY

YVPAGFTSKICPVTGFVNQLYPKYESVSKSQEFFSKFDKICYNLDKGYFEFSFDYKNFGD

KAAKGKWTIASFGSRLINFRNSDKNHNWDTREVYPTKELEKLLKDYSIEYGHGECIKAA

ICGESDKKFFAKLTSVLNTILQMRNSKTGTELDYLISPVADVNGNFFDSRQAPKNMPQD

ADANGAYHIGLKGLMLLDRIKNNQEGKKLNLVIKNEEYFEFVQNRNN

>WP_022501477_(modified) hypothetical protein
[*Eubacterium* sp. CAG: 76]
(SEQ ID NO: 79)
MNKAADNYTGGNYDEFIALSKVQKTLRNELKPTPFTAEHIKQRGIISEDEYRAQQSLELK

KIADEYYRNYITHKLNDINNLDFYNLFDAIEEKYKKNDKDNRDKLDLVEKSKRGEIAKM

LSADDNFKSMFEAKLITKLLPDYVERNYTGEDKEKALETLALFKGFTTYFKGYFKTRKN

MFSGEGGASSICHRIVNVNASIFYDNLKTFMRIQEKAGDEIALIEEELTEKLDGWRLEHIF

SRDYYNEVLAQKGIDYYNQICGDINKHMNLYCQQNKFKANIFKMMKIQKQIMGISEKA

FEIPPMYQNDEEVYASFNEFISRLEEVKLTDRLINILQNINIYNTAKIYINARYYTNVSSYV

YGGWGVIDSAIERYLYNTIAGKGQSKVKKIENAKKDNKFMSVKELDSIVAEYEPDYFNA

PYIDDDDNAVKAFGGQGVLGYFNKMSELLADVSLYTIDYNSDDSLIENKESALRIKKQL

DDIMSLYHWLQTFIIDEVVEKDNAFYAELEDICCELENVVTLYDRIRNYVTKKPYSTQKF

KLNFASPTLAAGWSRSKEFDNNAIILLRNNKYYIAIFNVNNKPDKQIIKGSEEQRLSTDYK

KMVYNLLPGPNKMLPKVFIKSDTGKRDYNPSSYILEGYEKNRHIKSSGNFDINYCHDLID

YYKACINKHPEWKNYGFKFKETNQYNDIGQFYKDVEKQGYSISWAYISEEDINKLDEEG

KIYLFEIYNKDLSAHSTGRDNLHTMYLKNIFSEDNLKNICIELNGEAELFYRKSSMKSNIT

HKKDTILVNKTYINETGVRVSLSDEDYMKVYNYYNNNYVIDTENDKNLIDIIEKIGHRKS

KIDIVKDKRYTEDKYFLYLPITINYGIEDENVNSKIIEYIAKQDNMNVIGIDRGERNLIYIS

VIDNKGNIIEQKSFNLVNNYDYKNKLKNMEKTRDNARKNWQEIGKIKDVKSGYLSGVIS

KIARMVIDYNAIIVMEDLNKGFKRGRFKVERQVYQKFENMLISKLNYLVFKERKADEN

GGILRGYQLTYIPKSIKNVGKQCGCIFYVPAAYTSKIDPATGFINIFDFKKYSGSGINAKV

KDKKEFLMSMNSIRYINECSEEYEKIGHRELFAFSFDYNNFKTYNVSSPVNEWTAYTYG

ERIKKLYKDGRWLRSEVLNLTENLIKLMEQYNIEYKDGHDIREDISHMDETRNADFICSL

FEELKYTVQLRNSKSEAEDENYDRLVSPILNSSNGFYDSSDYMENENNTTHTMPKDADA

NGAYCIALKGLYEINKIKQNWSDDKKFKENELYINVTEWLDYIQNRRFE

>WP_014550095_(modified) hypothetical protein
[*Francisella tularensis*]
(SEQ ID NO: 80)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQ

VAPKNLDNPSKKEQDLIAKKTEKAKYLSLETIKLALEEFNKHRDIDKQCRFEEILANFAAI

PMIFDEIAQNKDNLAQISIKYQNQGKKDLLQASAEDDVKAIKDLLDQTNNLLHRLKIFHI

SQSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGNPQKGYEKFEFNIEDCRKFIDFYK

ESISKHPEWKDFGFRFSDTQRYNSIDEFYREVENQGYKLTFENISESYIDSVVNQGKLYLF

QIYNKDFSAYSKGRPNLHTLYWKALFDERNLQDVVYKLNGEAELFYRKKSIPKKITHPA

KEAIANKNKDNPKKESFFEYDLIKDKRFTEDKFFFHCPITINFKSSGANKFNDEINLLLKE

KANDVHILSIDRGERHLAYYTLVDGKGNIIKQDTFNIIGNDRMKTNYHDKLAAIEKDRD

SARKDWKKINNIKEMKEGYLSQVVHEIAKLVIEHNAIVVFEDLNFGFKRGRFKVEKQVY

QKLEKMLIEKLNYLVFKDNEFDKTGGVLRAYQLTAPFETFKKMGKQTGIIYYVPAGFTS

KICPVTGFVNQLYPKYESVSKSQEFFSKFDKICYNLDKGYFEFSFDYKNFGDKAAKGKW

TIASFGSRLINFRNSDKNHNWDTREVYPTKELEKLLKDYSIEYGHGECIKAAICGESDKK

FFAKLTSILNTILQMRNSKTGTELDYLISPVADVNGNFFDSRQAPKNMPQDADANGAYH

IGLKGLMLLDRIKNNQEGKKLNLVIKNEEYFEFVQNRNN

>WP_003034647_(modified) hypothetical protein
[*Francisella tularensis*]
(SEQ ID NO: 81)

MSIYQEFVNKYSLSKTLRFELIPQGKTLENIKARGLILDDEKRAKDYKKAKQIIDKYHQFFIEEILS

SVCISEDLLQNYSDVYFKLKKSDDDNLQKDFKSAKDTIKKQISEYIKDSEKFKNLFNQNLIDAKK

GQESDLILWLKQSKDNGIELFKANSDITDIDEALEIIKSFKGWTTYFKGFHENRKNVYSSDDIPTSII

YRIVDDNLPKFLENKAKYESLKDKAPEAINYEQIKKDLAEELTFDIDYKTSEVNQRVFSLDEVFEI

ANFNNYLNQSGITKFNTIIGGKFVNGENTKRKGINEYINLYSQQINDKTLKKYKMSVLFKQILSDT

ESKSFVIDKLEDDSDVVTTMQSFYEQIAAFKTVEEKSIKETLSLLFDDLKAQKLDLSKIYFKNDKS

LTDLSQQVFDDYSVIGTAVLEYITQQVAPKNLDNPSKKEQDLIAKKTEKAKYLSLETIKLALEEF

NKHRDIDKQCRFEEILANFAAIPMIFDEIAQNKDNLAQISLKYQNQGKKDLLQASAEEDVKAIKD

LLDQTNNLLHRLKIFHISQSEDKANILDKDEHFYLVFEECYFELANIVPLYNKIRNYITQKPYSDEK

FKLNFENSTLANGWDKNKEPDNTAILFIKDDKYYLGVMNKKNNKIFDDKAIKENKGEGYKKIV

YKLLPGANKMLPKVFFSAKSIKFYNPSEDILRIRNHSTHTKNGNPQKGYEKFEFNIEDCRKFIDFY

KESISKHPEWKDFGFRFSDTQRYNSIDEFYREVENQGYKLTFENISESYIDSVVNQGKLYLFQIYN

KDFSAYSKGRPNLHTLYWKALFDERNLQDVVYKLNGEAELFYRKQSIPKKITHPAKEAIANKNK

DNPKKESVFEYDLIKDKRFTEDKFFFHCPITINFKSSGANKFNDEINLLLKEKANDVHILSIDRGER

HLAYYTLVDGKGNIIKQDTFNIIGNDRMKTNYHDKLAAIEKDRDSARKDWKKINNIKEMKEGYL

-continued

SQVVHEIAKLVIEHNAIVVFEDLNFGFKRGRFKVEKQVYQKLEKMLIEKLNYLVFKDNEFDKTG

GVLRAYQLTAPFETFKKMGKQTGIIYYVPAGFTSKICPVTGFVNQLYPKYESVSKSQEFFSKFDKI

CYNLDKGYFEFSFDYKNFGDKAAKGKWTIASFGSRLINFRNSDKNFINWDTREVYPTKELEKLLK

DYSIEYGHGECIKAAICGESDKKFFAKLTSVLNTILQMRNSKTGTELDYLISPVADVNGNFFDSRQ

APKNMPQDADANGAYHIGLKGLMLLDRIKNNQEGKKLNLVIKNEEYFEFVQNRNN

>FnCpf1 *Francisella tularensis* subsp. *novicida* U112,
complete genome (SEQ ID NO: 82)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQI

APKNLDNPSKKEQELIAKKTEKAKYLSLETIKLALEEFNKHRDIDKQCRFEEILANFAAIP

MIFDEIAQNKDNLAQISIKYQNQGKKDLLQASAEDDVKAIKDLLDQTNNLLHKLKIFHIS

QSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGSPQKGYEKFEFNIEDCRKFIDFYK

QSISKHPEWKDFGFRFSDTQRYNSIDEFYREVENQGYKLTFENISESYIDSVVNQGKLYL

FQIYNKDFSAYSKGRPNLHTLYWKALFDERNLQDVVYKLNGEAELFYRKQSIPKKITHP

AKEAIANKNKDNPKKESVFEYDLIKDKRFTEDKFFFHCPITINFKSSGANKFNDEINLLLK

EKANDVHILSIDRGERHLAYYTLVDGKGNIIKQDTFNIIGNDRMKTNYHDKLAAIEKDR

DSARKDWKKINNIKEMKEGYLSQVVHEIAKLVIEYNAIVVFEDLNFGFKRGRFKVEKQV

YQKLEKMLIEKLNYLVFKDNEFDKTGGVLRAYQLTAPFETFKKMGKQTGIIYYVPAGFT

SKICPVTGFVNQLYPKYESVSKSQEFFSKFDKICYNLDKGYFEFSFDYKNFGDKAAKGK

WTIASFGSRLINFRNSDKNHNWDTREVYPTKELEKLLKDYSIEYGHGECIKAAICGESDK

KFFAKLTSVLNTILQMRNSKTGTELDYLISPVADVNGNFFDSRQAPKNMPQDADANGA

YHIGLKGLMLLGRIKNNQEGKKLNLVIKNEEYFEFVQNRNN

>KKQ 38174_(modified) hypothetical protein US54_C0016G0015 [*Microgenomates* (*Roizmanbacteria*) *bacterium* GW2011_GWA2_37_7]

(SEQ ID NO: 83)

MKSFDSFTNLYSLSKTLKFEMRPVGNTQKMLDNAGVFEKDKLIQKKYGKTKPYFDRLH

REFIEEALTGVELIGLDENFRTLVDWQKDKKNNVAMKAYENSLQRLRTEIGKIFNLKAE

DWVKNKYPILGLKNKNTDILFEEAVFGILKARYGEEKDTFIEVEEIDKTGKSKINQISIFDS

WKGFTGYFKKFFETRKNFYKNDGTSTAIATRIIDQNLKRFIDNLSIVESVRQKVDLAETE

KSFSISLSQFFSIDFYNKCLLQDGIDYYNKIIGGETLKNGEKLIGLNELINQYRQNNKDQKI

PFFKLLDKQILSEKILFLDEIKNDTELIEALSQFAKTAEEKTKIVKKLFADFVENNSKYDL

AQIYISQEAFNTISNKWTSETETFAKYLFEAMKSGKLAKYEKKDNSYKFPDFIALSQMKS

ALLSISLEGHFWKEKYYKISKFQEKTNWEQFLAIFLYEFNSLFSDKINTKDGETKQVGYY

LFAKDLHNLILSEQIDIPKDSKVTIKDFADSVLTIYQMAKYFAVEKKRAWLAEYELDSFY

TQPDTGYLQFYDNAYEDIVQVYNKLRNYLTKKPYSEEKWKLNFENSTLANGWDKNKE

-continued

SDNSAVILQKGGKYYLGLITKGHNKIFDDRFQEKFIVGIEGGKYEKIVYKFFPDQAKMFP

KVCFSAKGLEFFRPSEEILRIYNNAEFKKGETYSIDSMQKLIDFYKDCLTKYEGWACYTF

RHLKPTEEYQNNIGEFFRDVAEDGYRIDFQGISDQYIHEKNEKGELHLFEIHNKDWNLDK

ARDGKSKTTQKNLHTLYFESLFSNDNVVQNFPIKLNGQAEIFYRPKTEKDKLESKKDKK

GNKVIDHKRYSENKIFFHVPLTLNRTKNDSYRFNAQINNFLANNKDINIIGVDRGEKHLV

YYSVITQASDILESGSLNELNGVNYAEKLGKKAENREQARRDWQDVQGIKDLKKGYIS

QVVRKLADLAIKHNAIIILEDLNMRFKQVRGGIEKSIYQQLEKALIDKLSFLVDKGEKNP

EQAGHLLKAYQLSAPFETFQKMGKQTGIIFYTQASYTSKSDPVTGWRPHLYLKYFSAKK

AKDDIAKFTKIEFVNDRFELTYDIKDFQQAKEYPNKTVWKVCSNVERFRWDKNLNQNK

GGYTHYTNITENIQELFTKYGIDITKDLLTQISTIDEKQNTSFFRDFIFYFNLICQIRNTDDS

EIAKKNGKDDFILSPVEPFFDSRKDNGNKLPENGDDNGAYNIARKGIVILNKISQYSEKN

ENCEKMKWGDLYVSNIDWDNFVTQANARH

>WP_022097749_(modified) hypothetical protein
[*Eubacterium eligens* CAG: 72]
(SEQ ID NO: 84)
MNGNRSIVYREFVGVTPVAKTLRNELRPVGHTQEHIIQNGLIQEDELRQEKSTELKNIMD

DYYREYIDKSLSGLTDLDFTLLFELMNSVQSSLSKDNKKALEKEHNKMREQICTHLQSD

SDYKNMFNAKLFKEILPDFIKNYNQYDVKDKAGKLETLALFNGFSTYFTDFFEKRKNVF

TKEAVSTSIAYRIVHENSLIFLANNITSYKKISEKALDEIEVIEKNNQDKMGDWELNQIFNP

DFYNMVLIQSGIDFYNEICGVVNAHMNLYCQQTKNNYNLFKMRKLHKQILAYTSTSFE

VPKMFEDDMSVYNAVNAFIDETEKGNIIGKLKDIVNKYDELDEKRIYISKDFYETLSCFM

SGNWNLITGCVENFYDENIHAKGKSKEEKVKKAVKEDKYKSINDVNDLVEKYIDEKER

NEFKNSNAKQYIREISNITTDTETAHLEYDEHISLIESEEKADEIKKRLDMYMNMYHWVK

AFIVDEVLDRDEMFYSDIDDIYNILENIVPLYNRVRNYVTQKPYTSKKIKLNFQSPTLANG

WSQSKEFDNNAIILIRDNKYYLAIFNAKNKPDKKIIQGNSDKKNDNDYKKMVYNLLPGA

NKMLPKVFLSKKGIETFKPSDYIISGYNAHKHIKTSENFDISFCRDLIDYFKNSIEKHAEW

RKYEFKFSATDSYNDISEFYREVEMQGYRIDWTYISEADINKLDEEGKIYLFQIYNKDFA

ENSTGKENLHTMYFKNIFSEENLKNIVIKLNGQAELFYRKASVKNPVKHKKDSVLVNKT

YKNQLDNGDVVRIPIPDDIYNEIYKMYNGYIKESDLSEAAKEYLDKVEVRTAQKDIVKD

YRYTVDKYFIHTPITINYKVTARNNVNDMAVKYIAQNDDIHVIGIDRGERNLIYISVIDSH

GNIVKQKSYNILNNYDYKKKLVEKEKTREYARKNWKSIGNIKELKEGYISGVVHEIAML

MVEYNAIIAMEDLNYGFKRGRFKVERQVYQKFESMLINKLNYFASKGKSVDEPGGLLK

GYQLTYVPDNIKNLGKQCGVIFYVPAAFTSKIDPSTGFISAFNFKSISTNASRKQFFMQFD

EIRYCAEKDMFSFGFDYNNFDTYNITMGKTQWTVYTNGERLQSEFNNARRTGKTKSINL

TETIKLLLEDNEINYADGHDVRIDMEKMYEDKNSEFFAQLLSLYKLTVQMRNSYTEAEE

QEKGISYDKIISPVINDEGEFFDSDNYKESDDKECKMPKDADANGAYCTALKGLYEVLKI

KSEWTEDGFDRNCLKLPHAEWLDFIQNKRYE

>WP_012739647_(modified) hypothetical protein
[[*Eubacterium*] *eligens*]
(SEQ ID NO: 85)
MNGNRSIVYREFVGVIPVAKTLRNELRPVGHTQEHIIQNGLIQEDELRQEKSTELKNIMD

DYYREYIDKSLSGVTDLDFTLLFELMNLVQSSPSKDNKKALEKEQSKMREQICTHLQSD

SNYKNIFNAKLLKEILPDFIKNYNQYDVKDKAGKLETLALFNGFSTYFTDFFEKRKNVFT

KEAVSTSIAYRIVHENSLIFLANMTSYKKISEKALDEIEVIEKNNQDKMGDWELNQIFNP

```
DFYNMVLIQSGIDFYNEICGVVNAHMNLYCQQTKNNYNLFKMRKLHKQILAYTSTSFE
VPKMFEDDMSVYNAVNAFIDETEKGNIIGKLKDIVNKYDELDEKRIYISKDFYETLSCFM
SGNWNLITGCVENFYDENIHAKGKSKEEKVKKAVKEDKYKSINDVNDLVEKYIDEKER
NEFKNSNAKQYIREISNITTDTETAHLEYDDHISLIESEEKADEMKKRLDMYMNMYHWA
KAFIVDEVLDRDEMFYSDIDDIYNILENIVPLYNRVRNYVTQKPYNSKKIKLNFQSPTLA
NGWSQSKEFDNNAIILIRDNKYYLAIFNAKNKPDKKIIQGNSDKKNDNDYKKMVYNLLP
GANKMLPKVFLSKKGIETFKPSDYIISGYNAHKHIKTSENFDISFCRDLIDYFKNSIEKHAE
WRKYEFKFSATDSYSDISEFYREVEMQGYRIDWTYISEADINKLDEEGKIYLFQIYNKDF
AENSTGKENLHTMYFKNIFSEENLKDIIIKLNGQAELFYRRASVKNPVKHKKDSVLVNK
TYKNQLDNGDVVRIPIPDDIYNEIYKMYNGYIKESDLSEAAKEYLDKVEVRTAQKDIVK
DYRYTVDKYFIHTPITINYKVTARNNVNDMVVKYIAQNDDIHVIGIDRGERNLIYISVIDS
HGNIVKQKSYNILNNYDYKKKLVEKEKTREYARKNWKSIGNIKELKEGYISGVVHEIAM
LIVEYNAIIAMEDLNYGFKRGRFKVERQVYQKFESMLINKLNYFASKEKSVDEPGGLLK
GYQLTYVPDNIKNLGKQCGVIFYVPAAFTSKIDPSTGFISAFNFKSISTNASRKQFFMQFD
EIRYCAEKDMFSFGFDYNNFDTYNITMGKTQWTVYTNGERLQSEFNNARRTGKTKSINL
TETIKLLLEDNEINYADGHDIRIDMEKMDEDKKSEFFAQLLSLYKLTVQMRNSYTEAEE
QENGISYDKIISPVINDEGEFFDSDNYKESDDKECKMPKDADANGAYCIALKGLYEVLKI
KSEWTEDGFDRNCLKLPHAEWLDFIQNKRYE
>WP_045971446_(modified) hypothetical protein
[Flavobacterium sp. 316]
                                                    (SEQ ID NO: 86)
MKNFSNLYQVSKTVRFELKPIGNTLENIKNKSLLKNDSIRAESYQKMKKTIDEFHKYFID
LALNNKKLSYLNEYIALYTQSAEAKKEDKFKADFKKVQDNLRKEIVSSFTEGEAKAIFS
VLDKKELITIELEKWKNENNLAVYLDESFKSFTTYFTGFHQNRKNMYSAEANSTAIAYR
LIHENLPKFIENSKAFEKSSQIAELQPKIEKLYKEFEAYLNVNSISELFEIDYFNEVLTQKGI
TVYNNIIGGRTATEGKQKIQGLNEIINLYNQTKPKNERLPKLKQLYKQILSDRISLSFLPD
AFTEGKQVLKAVFEFYKINLLSYKQDGVEESQNLLELIQQVVKNLGNQDVNKIYLKNDT
SLTTIAQQLFGDFSVFSAALQYRYETVVNPKYTAEYQKANEAKQEKLDKEKIKFVKQDY
FSIAFLQEVVADYVKTLDENLDWKQKYTPSCIADYFTTHFIAKKENEADKTFNFIANIKA
KYQCIQGILEQADDYEDELKQDQKLIDNIKFFLDAILEVVHFIKPLHLKSESITEKDNAFY
DVFENYYEALNVVTPLYNMVRNYVTQKPYSTEKIKLNFENAQLLNGWDANKEKDYLT
TILKRDGNYFLAIMDKKHNKTFQQFTEDDENYEKIVYKLLPGVNKMLPKVFFSNKNIAF
FNPSKEILDNYKNNTHKKGATFNLKDCHALIDFFKDSLNKHEDWKYFDFQFSETKTYQD
LSGFYKEVEHQGYKINFKKVSVSQIDTLIEEGKMYLFQIYNKDFSPYAKGKPNMHTLYW
KALFETQNLENVIYKLNGQAEIFFRKASIKKKNIITHKAHQPIAAKNPLTPTAKNTFAYDL
IKDKRYTVDKFQFHVPITMNFKATGNSYINQDVLAYLKDNPEVNIIGLDRGERHLVYLT
LIDQKGTILLQESLNVIQDEKTHTPYHTLLDNKEIARDKARKNWGSIESIKELKEGYISQV
VHKITKMMIEHNAIVVMEDLNFGFKRGRFKVEKQIYQKLEKMLIDKLNYLVLKDKQPH
ELGGLYNALQLTNKFESFQKMGKQSGFLFYVPAWNTSKIDPTTGFVNYFYTKYENVEK
AKTFFSKFDSILYNKTKGYFEFVVKNYSDFNPKAADTRQEWTICTHGERIETKRQKEQN
NNFVSTTIQLTEQFVNFFEKVGLDLSKELKTQLIAQNEKSFFEELFHLLKLTLQMRNSESH
```

-continued

TEIDYLISPVANEKGIFYDSRKATASLPIDADANGAYHIAKKGLWIMEQINKTNSEDDLK

KVKLAISNREWLQYVQQVQKK

>WP_044110123_(modified) hypothetical protein
[*Prevotella brevis*]

(SEQ ID NO: 87)

MKQFTNLYQLSKTLRFELKPIGKTLEHINANGFIDNDAHRAESYKKVKKLIDDYHKDYIE

NVLNNFKLNGEYLQAYFDLYSQDTKDKQFKDIQDKLRKSIASALKGDDRYKTIDKKELI

RQDMKTFLKKDTDKALLDEFYEFTTYFTGYHENRKNMYSDEAKSTAIAYRLIHDNLPKF

IDNIAVFKKIANTSVADNFSTIYKNFEEYLNVNSIDEIFSLDYYNIVLTQTQIEVYNSIIGGR

TLEDDTKIQGINEFVNLYNQQLANKKDRLPKLKPLFKQILSDRVQLSWLQEEFNTGADV

LNAVKEYCTSYFDNVEESVKVLLTGISDYDLSKIYITNDLALTDVSQRMFGEWSIIPNAIE

QRLRSDNPKKTNEKEEKYSDRISKLKKLPKSYSLGYINECISELNGIDIADYYATLGAINT

ESKQEPSIPTSIQVHYNALKPILDTDYPREKNLSQDKLTVMQLKDLLDDFKALQHFIKPLL

GNGDEAEKDEKFYGELMQLWEVIDSITPLYNKVRNYCTRKPFSTEKIKVNFENAQLLDG

WDENKESTNASIILRKNGMYYLGIMKKEYRNILTKPMPSDGDCYDKVVYKFFKDITTM

VPKCTTQMKSVKEHFSNSNDDYTLFEKDKFIAPVVITKEIFDLNNVLYNGVKKFQIGYL

NNTGDSFGYNHAVEIWKSFCLKFLKAYKSTSIYDFSSIEKNIGCYNDLNSFYGAVNLLLY

NLTYRKVSVDYIHQLVDEDKMYLFMIYNKDFSTYSKGTPNMHTLYWKMLFDESNLND

VVYKLNGQAEVFYRKKSITYQHPTHPANKPIDNKNVNNPKKQSNFEYDLIKDKRYTVD

KFMFHVPITLNFKGMGNGDINMQVREYIKTTDDLHFIGIDRGERHLLYICVINGKGEIVE

QYSLNEIVNNYKGTEYKTDYHTLLSERDKKRKEERSSWQTIEGIKELKSGYLSQVIHKIT

QLMIKYNAIVLLEDLNMGFKRGRQKVESSVYQQFEKALIDKLNYLVDKNKDANEIGGL

LHAYQLTNDPKLPNKNSKQSGFLFYVPAWNTSKIDPVTGFVNLLDTRYENVAKAQAFF

KKFDSIRYNKEYDRFEFKFDYSNFTAKAEDTRTQWTLCTYGTRIETFRNAEKNSNWDSR

EIDLTTEWKTLFTQHNIPLNANLKEAILLQANKNFYTDILHLMKLTLQMRNSVTGTDIDY

MVSPVANECGEFFDSRKVKEGLPVNADANGAYNIARKGLWLAQQIKNANDLSDVKLAI

TNKEWLQFAQKKQYLKD

>WP_036388671_(modified) hypothetical protein
[*Moraxella caprae*]

(SEQ ID NO: 88)

MLFQDFTHLYPLSKTMRFELKPIGKTLEHIHAKNFLSQDETMADMYQKVKAILDDYHR

DFIADMMGEVKLTKLAEFYDVYLKFRKNPKDDGLQKQLKDLQAVLRKEIVKPIGNGGK

YKAGYDRLFGAKLFKDGKELGDLAKFVIAQEGESSPKLAHLAHFEKFSTYFTGFHDNRK

NMYSDEDKHTAITYRLIHENLPRFIDNLQILATIKQKHSALYDQIINELTASGLDVSLASH

LDGYHKLLTQEGITAYNTLLGGISGEAGSRKIQGINELINSHHNQHCHKSERIAKLRPLHK

QILSDGMGVSFLPSKFADDSEMCQAVNEFYRHYADVFAKVQSLFDGFDDHQKDGIYVE

HKNLNELSKQAFGDFALLGRVLDGYYVDVVNPEFNERFAKAKTDNAKAKLTKEKDKFI

KGVHSLASLEQAIEHYTARHDDESVQAGKLGQYFKHGLAGVDNPIQKIHNNHSTIKGFL

ERERPAGERALPKIKSGKNPEMTQLRQLKELLDNALNVAHFAKLLTTKTTLDNQDGNF

YGEFGALYDELAKIPTLYNKVRDYLSQKPFSTEKYKLNFGNPTLLNGWDLNKEKDNFGI

ILQKDGCYYLALLDKAHKKVFDNAPNTGKNVYQKMIYKLLPGPNKMLPKVFFAKSNL

DYYNPSAELLDKYAQGTHKKGNNFNLKDCHALIDFFKAGINKHPEWQHFGFKFSPTSSY

QDLSDFYREVEPQGYQVKFVDINADYINELVEQGQLYLFQIYNKDFSPKAHGKPNLHTL

-continued

YFKALFSKDNLANPIYKLNGEAQIFYRKASLDMNETTIHRAGEVLENKNPDNPKKRQFV

YDIIKDKRYTQDKFMLHVPITMNFGVQGMTIKEFNKKVNQSIQQYDEVNVIGIDRGERH

LLYLTVINSKGEILEQRSLNDITTASANGTQMTTPYHKILDKREIERLNARVGWGEIETIK

ELKSGYLSHVVHQISQLMLKYNAIVVLEDLNFGFKRGRFKVEKQIYQNFENALIKKLNH

LVLKDEADDEIGSYKNALQLTNNFTDLKSIGKQTGFLFYVPAWNTSKIDPETGFVDLLKP

RYENIAQSQAFFGKFDKICYNADKDYFEFHIDYAKFTDKAKNSRQIWKICSHGDKRYVY

DKTANQNKGATKGINVNDELKSLFARHHINDKQPNLVMDICQNNDKEFHKSLIYLLKTL

LALRYSNASSDEDFILSPVANDEGMFFNSALADDTQPQNADANGAYHIALKGLWVLEQI

KNSDDLNKVKLAIDNQTWLNFAQNR

>WP_020988726_(modified) CRISPR-associated protein Cpf1,
subtype PREFRAN [*Leptospira inadai*]
(SEQ ID NO: 89)

MEDYSGFVNIYSIQKTLRFELKPVGKTLEHIEKKGFLKKDKIRAEDYKAVKKIIDKYHRA

YIEEVFDSVLHQKKKKDKTRFSTQFIKEIKEFSELYYKTEKNIPDKERLEALSEKLRKMLV

GAFKGEFSEEVAEKYKNLFSKELIRNEIEKFCETDEERKQVSNFKSFTTYFTGFHSNRQNI

YSDEKKSTAIGYRIIHQNLPKFLDNLKIIESIQRRFKDFPWSDLKKNLKKIDKNIKLTEYFSI

DGFVNVLNQKGIDAYNTILGGKSEESGEKIQGLNEYINLYRQKNNIDRKNLPNVKILFKQ

ILGDRETKSFIPEAFPDDQSVLNSITEFAKYLKLDKKKKSIIAELKKFLSSFNRYELDGIYL

ANDNSLASISTFLFDDWSFIKKSVSFKYDESVGDPKKKIKSPLKYEKEKEKWLKQKYYTI

SFLNDAIESYSKSQDEKRVKIRLEAYFAEFKSKDDAKKQFDLLERIEEAYAIVEPLLGAEY

PRDRNLKADKKEVGKIKDFLDSIKSLQFFLKPLLSAEIFDEKDLGFYNQLEGYYEEIDSIG

HLYNKVRNYLTGKIYSKEKFKLNFENSTLLKGWDENREVANLCVIFREDQKYYLGVMD

KENNTILSDIPKVKPNELFYEKMVYKLIPTPHMQLPRIIFSSDNLSIYNPSKSILKIREAKSF

KEGKNFKLKDCHKFIDFYKESISKNEDWSRFDFKFSKTSSYENISEFYREVERQGYNLDF

KKVSKFYIDSLVEDGKLYLFQIYNKDFSIFSKGKPNLHTIYFRSLFSKENLKDVCLKLNGE

AEMFFRKKSINYDEKKKREGHHPELFEKLKYPILKDKRYSEDKFQFHLPISLNFKSKERL

NFNLKVNEFLKRNKDINIIGIDRGERNLLYLVMINQKGEILKQTLLDSMQSGKGRPEINY

KEKLQEKEIERDKARKSWGTVENIKELKEGYLSIVIHQISKLMVENNAIVVLEDLNIGFK

RGRQKVERQVYQKFEKMLIDKLNFLVFKENKPTEPGGVLKAYQLTDEFQSFEKLSKQT

GFLFYVPSWNTSKIDPRTGFIDFLHPAYENIEKAKQWINKFDSIRFNSKMDWFEFTADTR

KFSENLMLGKNRVWVICTTNVERYFTSKTANSSIQYNSIQITEKLKELFVDIPFSNGQDLK

PEILRKNDAVFFKSLLFYIKTTLSLRQNNGKKGEEEKDFILSPVVDSKGRFFNSLEASDDE

PKDADANGAYHIALKGLMNLLVLNETKEENLSRPKWKIKNKDWLEFVWERNR

>WP_023936172_(modified) exonuclease SbcC
[*Porphyromonas crevioricanis*]
(SEQ ID NO: 90)

MPWIDLKDFTNLYPVSKTLRFELKPVGKTLENIEKAGILKEDEHRAESYRRVKKIIDTYH

KVFIDSSLENMAKMGIENEIKAMLQSFCELYKKDHRTEGEDKALDKIRAVLRGLIVGAF

TGVCGRRENTVQNEKYESLFKEKLIKEILPDFVLSTEAESLPFSVEEATRSLKEFDSFTSYF

AGFYENRKNIYSTKPQSTAIAYRLIHENLPKFIDNILVFQKIKEPIAKELEHIRADFSAGGYI

KKDERLEDIFSLNYYIHVLSQAGIEKYNALIGKIVTEGDGEMKGLNEHINLYNQQRGRED

RLPLFRPLYKQILSDREQLSYLPESFEKDEELLRALKEFYDHIAEDILGRTQQLMTSISEYD

LSRIYVRNDSQLTDISKKMLGDWNAIYMARERAYDHEQAPKRITAKYERDRIKALKGEE

SISLANLNSCIAFLDNVRDCRVDTYLSTLGQKEGPHGLSNLVENVFASYHEAEQLLSFPY

-continued

PEENNLIQDKDNVVLIKNLLDNISDLQRFLKPLWGMGDEPDKDERFYGEYNYIRGALDQ

VIPLYNKVRNYLTRKPYSTRKVKLNFGNSQLLSGWDRNKEKDNSCVILRKGQNFYLAI

MNNRHKRSFENKVLPEYKEGEPYFEKMDYKFLPDPNKMLPKVFLSKKGIEIYEPSPKLL

EQYGHGTHKKGDTFSMDDLHELIDFFKHSIEAHEDWKQFGFKFSDTATYENVSSFYREV

EDQGYKLSFRKVSESYVYSLIDQGKLYLFQIYNKDFSPCSKGTPNLHTLYWRMLFDERN

LADVIYKLDGKAEIFFREKSLKNDHPTHPAGKPIKKKSRQKKGEESLFEYDLVKDRRYT

MDKFQFHVPITMNFKCSAGSKVNDMVNAHIREAKDMHVIGIDRGERNLLYICVIDSRGT

ILDQISLNTINDIDYHDLLESRDKDRQQERRNWQTIEGIKELKQGYLSQAVHRIAELMVA

YKAVVALEDLNMGFKRGRQKVESSVYQQFEKQLIDKLNYLVDKKKRPEDIGGLLRAYQ

FTAPFKSFKEMGKQNGFLFYIPAWNTSNIDPTTGFVNLFHAQYENVDKAKSFFQKFDSIS

YNPKKDWFEFAFDYKNFTKKAEGSRSMWILCTHGSRIKNFRNSQKNGQWDSEEFALTE

AFKSLFVRYEIDYTADLKTAIVDEKQKDFFVDLLKLFKLTVQMRNSWKEKDLDYLISPV

AGADGRFFDTREGNKSLPKDADANGAYNIALKGLWALRQIRQTSEGGKLKLAISNKEW

LQFVQERSYEKD

>WP_009217842_(modified) hypothetical protein
[*Bacteroidetes oral taxon* 274]
(SEQ ID NO: 91)
MRKFNEFVGLYPISKTLRFELKPIGKTLEHIQRNKLLEHDAVRADDYVKVKKIIDKYHKC

LIDEALSGFTFDTEADGRSNNSLSEYYLYYNLKKRNEQEQKTFKTIQNNLRKQIVNKLTQ

SEKYKRIDKKELITTDLPDFLTNESEKELVEKFKNFTTYFTEFHKNRKNMYSKEEKSTAI

AFRLINENLPKFVDNIAAFEKVVSSPLAEKINALYEDFKEYLNVEEISRVFRLDYYDELLT

QKQIDLYNAIVGGRTEEDNKIQIKGLNQYINEYNQQQTDRSNRLPKLKPLYKQILSDRES

VSWLPPKFDSDKNLLIKIKECYDALSEKEKVFDKLESILKSLSTYDLSKIYISNDSQLSYIS

QKMFGRWDIISKAIREDCAKRNPQKSRESLEKFAERIDKKLKTIDSISIGDVDECLAQLGE

TYVKRVEDYFVAMGESEIDDEQTDTTSFKKNIEGAYESVKELLNNADNITDNNLMQDK

GNVEKIKTLLDAIKDLQRFIKPLLGKGDEADKDGVFYGEFTSLWTKLDQVTPLYNMVR

NYLTSKPYSTKKIKLNFENSTLMDGWDLNKEPDNTTVIFCKDGLYYLGIMGKKYNRVF

VDREDLPHDGECYDKMEYKLLPGANKMLPKVFFSETGIQRFLPSEELLGKYERGTHKK

GAGFDLGDCRALIDFFKKSIERHDDWKKFDFKFSDTSTYQDISEFYREVEQQGYKMSFR

KVSVDYIKSLVEEGKLYLFQIYNKDFSAHSKGTPNMHTLYWKMLFDEENLKDVVYKLN

GEAEVFFRKSSITVQSPTHPANSPIKNKNKDNQKKESKFEYDLIKDRRYTVDKFLFHVPIT

MNFKSVGGSNINQLVKRHIRSATDLHIIGIDRGERHLLYLTVIDSRGNIKEQFSLNEIVNE

YNGNTYRTDYHELLDTREGERTEARRNWQTIQNIRELKEGYLSQVIHKISELAIKYNAVI

VLEDLNFGFMRSRQKVEKQVYQKFEKMLIDKLNYLVDKKKPVAETGGLLRAYQLTGEF

ESFKTLGKQSGILFYVPAWNTSKIDPVTGFVNLFDTHYENIEKAKVFFDKFKSIRYNSDK

DWFEFVVDDYTRFSPKAEGTRRDWTICTQGKRIQICRNHQRNNEWEGQEIDLTKAFKEH

FEAYGVDISKDLREQINTQNKKEFFEELLRLLRLTLQMRNSMPSSDIDYLISPVANDTGCF

FDSRKQAELKENAVLPMNADANGAYNIARKGLLAIRKMKQEENDSAKISLAISNKEWL

KFAQTKPYLED

>WP_036890108_(modified) hypothetical protein
[*Porphyromonas crevioricanis*]
(SEQ ID NO: 92)

MDSLKDFTNLYPVSKTLRFELKPVGKTLENIEKAGILKEDEHRAESYRRVKKIIDTYHKV

FIDSSLENMAKMGIENEIKAMLQSFCELYKKDHRTEGEDKALDKIRAVLRGLIVGAFTG

VCGRRENTVQNEKYESLFKEKLIKEILPDFVLSTEAESLPFSVEEATRSLKEFDSFTSYFA

GFYENRKNIYSTKPQSTAIAYRLIHENLPKFIDNILVFQKIKEPIAKELEHIRADFSAGGYIK

KDERLEDIFSLNYYIHVLSQAGIEKYNALIGKIVTEGDGEMKGLNEHINLYNQQRGREDR

LPLFRPLYKQILSDREQLSYLPESFEKDEELLRALKEFYDHIAEDILGRTQQLMTSISEYDL

SRIYVRNDSQLTDISKKMLGDWNAIYMARERAYDHEQAPKRITAKYERDRIKALKGEES

ISLANLNSCIAFLDNVRDCRVDTYLSTLGQKEGPHGLSNLVENVFASYHEAEQLLSFPYP

EENNLIQDKDNVVLIKNLLDNISDLQRFLKPLWGMGDEPDKDERFYGEYNYIRGALDQV

IPLYNKVRNYLTRKPYSTRKVKLNFGNSQLLSGWDRNKEKDNSCVILRKGQNFYLAIM

NNRHKRSFENKMLPEYKEGEPYFEKMDYKFLPDPNKMLPKVFLSKKGIEIYKPSPKLLE

QYGHGTHKKGDTFSMDDLHELIDFFKHSIEAHEDWKQFGFKFSDTATYENVSSFYREVE

DQGYKLSFRKVSESYVYSLIDQGKLYLFQIYNKDFSPCSKGTPNLHTLYWRMLFDERNL

ADVIYKLDGKAEIFFREKSLKNDHPTHPAGKPIKKKSRQKKGEESLFEYDLVKDRRYTM

DKFQFHVPITMNFKCSAGSKVNDMVNAHIREAKDMHVIGIDRGERNLLYICVIDSRGTIL

DQISLNTINDIDYHDLLESRDKDRQQEHRNWQTIEGIKELKQGYLSQAVHRIAELMVAY

KAVVALEDLNMGFKRGRQKVESSVYQQFEKQLIDKLNYLVDKKKRPEDIGGLLRAYQF

TAPFKSFKEMGKQNGFLFYIPAWNTSNIDPTTGFVNLFHVQYENVDKAKSFFQKFDSISY

NPKKDWFEFAFDYKNFTKKAEGSRSMWILCTHGSRIKNFRNSQKNGQWDSEEFALTEA

FKSLFVRYEIDYTADLKTAIVDEKQKDFFVDLLKLFKLTVQMRNSWKEKDLDYLISPVA

GADGRFFDTREGNKSLPKADANGAYNIALKGLWALRQIRQTSEGGKLKLAISNKEWL

QFVQERSYEKD

>WP_036887416_(modified) hypothetical protein
[*Porphyromonas crevioricanis*]
(SEQ ID NO: 93)

MDSLKDFTNLYPVSKTLRFELKPVGKTLENIEKAGILKEDEHRAESYRRVKKIIDTYHKV

FIDSSLENMAKMGIENEIKAMLQSFCELYKKDHRTEGEDKALDKIRAVLRGLIVGAFTG

VCGRRENTVQNEKYESLFKEKLIKEILPDFVLSTEAESLPFSVEEATRSLKEFDSFTSYFA

GFYENRKNIYSTKPQSTAIAYRLIHENLPKFIDNILVFQKIKEPIAKELEHIRADFSAGGYIK

KDERLEDIFSLNYYIHVLSQAGIEKYNALIGKIVTEGDGEMKGLNEHINLYNQQRGREDR

LPLFRPLYKQILSDREQLSYLPESFEKDEELLRALKEFYDHIAEDILGRTQQLMTSISEYDL

SRIYVRNDSQLTDISKKMLGDWNAIYMARERAYDHEQAPKRITAKYERDRIKALKGEES

ISLANLNSCIAFLDNVRDCRVDTYLSTLGQKEGPHGLSNLVENVFASYHEAEQLLSFPYP

EENNLIQDKDNVVLIKNLLDNISDLQRFLKPLWGMGDEPDKDERFYGEYNYIRGALDQV

IPLYNKVRNYLTRKPYSTRKVKLNFGNSQLLSGWDRNKEKDNSCVILRKGQNFYLAIM

NNRHKRSFENKVLPEYKEGEPYFEKMDYKFLPDPNKMLPKVFLSKKGIEIYKPSPKLLE

QYGHGTHKKGDTFSMDDLHELIDFFKHSIEAHEDWKQFGFKFSDTATYENVSSFYREVE

DQGYKLSFRKVSESYVYSLIDQGKLYLFQIYNKDFSPCSKGTPNLHTLYWRMLFDERNL

ADVIYKLDGKAEIFFREKSLKNDHPTHPAGKPIKKKSRQKKGEESLFEYDLVKDRHYTM

DKFQFHVPITMNFKCSAGSKVNDMVNAHIREAKDMHVIGIDRGERNLLYICVIDSRGTIL

-continued

DQISLNTINDIDYHDLLESRDKDRQQERRNWQTIEGIKELKQGYLSQAVHRIAELMVAY

KAVVALEDLNMGFKRGRQKVESSVYQQFEKQLIDKLNYLVDKKKRPEDIGGLLRAYQF

TAPFKSFKEMGKQNGFLFYIPAWNTSNIDPTTGFVNLFHAQYENVDKAKSFFQKFDSISY

NPKKDWFEFAFDYKNFTKKAEGSRSMWILCTHGSRIKNFRNSQKNGQWDSEEFALTEA

FKSLFVRYEIDYTADLKTAIVDEKQKDFFVDLLKLFKLTVQMRNSWKEKDLDYLISPVA

GADGRFFDTREGNKSLPKDADANGAYNIALKGLWALRQIRQTSEGGKLKLAISNKEWL

QFVQERSYEKD

>WP_023941260_(modified) exonuclease SbcC
[*Porphyromonas cansulci*]
(SEQ ID NO: 94)
MDSLKDFTNLYPVSKTLRFELKPVGKTLENIEKAGILKEDEHRAESYRRVKKIIDTYHKV

FIDSSLENMAKMGIENEIKAMLQSFCELYKKDHRTEGEDKALDKIRAVLRGLIVGAFTG

VCGRRENTVQNEKYESLFKEKLIKEILPDFVLSTEAESLPFSVEEATRSLKEFDSFTSYFA

GFYENRKNIYSTKPQSTAIAYRLIHENLPKFIDNILVFQKIKEPIAKELEHIRADFSAGGYIK

KDERLEDIFSLNYYIHVLSQAGIEKYNALIGKIVTEGDGEMKGLNEHINLYNQQRGREDR

LPLFRPLYKQILSDREQLSYLPESFEKDEELLRALKEFYDHIAEDILGRTQQLMTSISEYDL

SRIYVRNDSQLTDISKKMLGDWNAIYMARERAYDHEQAPKRITAKYERDRIKALKGEES

ISLANLNSCIAFLDNVRDCRVDTYLSTLGQKEGPHGLSNLVENVFASYHEAEQLLSFPYP

EENNLIQDKDNVVLIKNLLDNISDLQRFLKPLWGMGDEPDKDERFYGEYNYIRGALDQV

IPLYNKVRNYLTRKPYSTRKVKLNFGNSQLLSGWDRNKEKDNSCVILRKGQNFYLAIM

NNRHKRSFENKVLPEYKEGEPYFEKMDYKFLPDPNKMLPKVFLSKKGIEIYKPSPKLLE

QYGHGTHKKGDTFSMDDLHELIDFFKHSIEAHEDWKQFGFKFSDTATYENVSSFYREVE

DQGYKLSFRKVSESYVYSLIDQGKLYLFQIYNKDFSPCSKGTPNLHTLYWRMLFDERNL

ADVIYKLDGKAEIFFREKSLKNDHPTHPAGKPIKKKSRQKKGEESLFEYDLVKDRRYTM

DKFQFHVPITMNFKCSAGSKVNDMVNAHIREAKDMHVIGIDRGERNLLYICVIDSRGTIL

DQISLNTINDIDYHDLLESRDKDRQQERRNWQTIEGIKELKQGYLSQAVHRIAELMVAY

KAVVALEDLNMGFKRGRQKVESSVYQQFEKQLIDKLNYLVDKKKRPEDIGGLLRAYQF

TAPFKSFKEMGKQNGFLFYIPAWNTSNIDPTTGFVNLFHAQYENVDKAKSFFQKFDSISY

NPKKDWFEFAFDYKNFTKKAEGSRSMWILCTHGSRIKNFRNSQKNGQWDSEEFALTEA

FKSLFVRYEIDYTADLKTAIVDEKQKDFFVDLLKLFKLTVQMRNSWKEKDLDYLISPVA

GADGRFFDTREGNKSLPKDADANGAYNIALKGLWALRQIRQTSEGGKLKLAISNKEWL

QFVQERSYEKD

>WP_037975888_(modified) hypothetical protein
[*Synergistes jonesii*]
(SEQ ID NO: 95)
MANSLKDFTNIYQLSKTLRFELKPIGKTEEHINRKLIIMHDEKRGEDYKSVTKLIDDYHR

KFIHETLDPAHFDWNPLAEALIQSGSKNNKALPAEQKEMREKIISNIFTSQAVYKKLFKK

ELFSELLPEMIKSELVSDLEKQAQLDAVKSFDKFSTYFTGFHENRKNIYSKKDTSTSIAFR

IVHQNFPKFLANVRAYTLIKERAPEVIDKAQKELSGILGGKTLDDIFSIESFNNVLTQDKID

YYNQIIGGVSGKAGDKKLRGVNEFSNLYRQQHPEVASLRIKMVPLYKQILSDRTTLSFVP

EALKDDEQAINAVDGLRSELERNDIFNRIKRLFGKNNLYSLDKIWIKNSSISAFSNELFKN

WSFIEDALKEFKENEFNGARSAGKKAEKWLKSKYFSFADIDAAVKSYSEQVSADISSAP

SASYFAKFTNLIETAAENGRKFSYFAAESKAFRGDDGKTEIIKAYLDSLNDILHCLKPFET

EDISDIDTEFYSAFAEIYDSVKDVIPVYNAVRNYTTQKPFSTEKFKLNFENPALAKGWDK

```
NKEQNNTAIILMKDGKYYLGVIDKNNKLRADDLADDGSAYGYMKMNYKFIPTPHMEL

PKVFLPKRAPKRYNPSREILLIKENKTFIKDKNFNRTDCHKLIDFFKDSINKHKDWRTFGF

DFSDTDSYEDISDFYMEVQDQGYKLTFTRLSAEKIDKWVEEGRLFLFQIYNKDFADGAQ

GSPNLHTLYWKAIFSEENLKDVVLKLNGEAELFFRRKSIDKPAVHAKGSMKVNRRDIDG

NPIDEGTYVEICGYANGKRDMASLNAGARGLIESGLVRITEVKHELVKDKRYTIDKYFF

HVPFTINFKAQGQGNINSDVNLFLRNNKDVNIIGIDRGERNLVYVSLIDRDGHIKLQKDF

NIIGGMDYHAKLNQKEKERDTARKSWKTIGTIKELKEGYLSQVVHEIVRLAVDNNAVIV

MEDLNIGFKRGRFKVEKQVYQKFEKMLIDKLNYLVFKDAGYDAPCGILKGLQLTEKFES

FTKLGKQCGIIFYIPAGYTSKIDPTTGFVNLFNINDVSSKEKQKDFIGKLDSIRFDAKRDM

FTFEFDYDKFRTYQTSYRKKWAVWTNGKRIVREKDKDGKFRMNDRLLTEDMKNILNK

YALAYKAGEDILPDVISRDKSLASEIFYVFKNTLQMRNSKRDTGEDFIISPVLNAKGRFFD

SRKTDAALPIDADANGAYHIALKGSLVLDAIDEKLKEDGRIDYKDMAVSNPKWFEFMQ

TRKFDF

>EFI70750_(modified) conserved hypothetical protein
[Prevotella bryantii B14]
                                                                (SEQ ID NO: 96)
MQINNLKIIYMKFTDFTGLYSLSKTLRFELKPIGKTLENIKKAGLLEQDQHRADSYKKVK

KIIDEYHKAFIEKSLSNFELKYQSEDKLDSLEEYLMYYSMKRIEKTEKDKFAKIQDNLRK

QIADHLKGDESYKTIFSKDLIRKNLPDFVKSDEERTLIKEFKDFTTYFKGFYENRENMYS

AEDKSTAISHRBHENLPKFVDNINAFSKIILIPELREKLNQIYQDFEEYLNVESIDEIFHLDY

FSMVMTQKQIEVYNAIIGGKSTNDKKIQGLNEYINLYNQKHKDCKLPKLKLLFKQILSDR

IAISWLPDNFKDDQEALDSIDTCYKNLLNDGNVLGEGNLKLLLENIDTYNLKGIFIRNDL

QLTDISQKMYASWNVIQDAVILDLKKQVSRKKKESAEDYNDRLKKLYTSQESFSIQYLN

DCLRAYGKTENIQDYFAKLGAVNNEHEQTINLFAQVRNAYTSVQAILTTPYPENANLAQ

DKETVALIKNLLDSLKRLQRFIKPLLGKGDESDKDERFYGDFTPLWETLNQITPLYNMVR

NYMTRKPYSQEKIKLNFENSTLLGGWDLNKEHDNTABLRKNGLYYLAIMKKSANKIFD

KDKLDNSGDCYEKMVYKLLPGANKMLPKVFFSKSRIDEFKPSENIIENYKKGTHKKGA

NFNLADCHNLIDFFKSSISKHEDWSKFNFHFSDTSSYEDLSDFYREVEQQGYSISFCDVSV

EYINKMVEKGDLYLFQIYNKDFSEFSKGTPNMHTLYWNSLFSKENLNNIIYKLNGQAEIF

FRKKSLNYKRPTHPAHQAIKNKNKCNEKKESIFDYDLVKDKRYTVDKFQFHVPITMNFK

STGNTNINQQVIDYLRTEDDTHIIGIDRGERHLLYLVVIDSHGKIVEQFTLNEIVNEYGGNI

YRTNYHDLLDTREQNREKARESWQTIENIKELKEGYISQVIHKITDLMQKYHAVVVLED

LNMGFMRGRQKVEKQVYQKFEEMLINKLNYLVNKKADQNSAGGLLHAYQLTSKFESF

QKLGKQSGFLFYIPAWNTSKIDPVTGFVNLFDTRYESIDKAKAFFGKFDSIRYNADKDW

FEFAFDYNNFTTKAEGTRTNWTICTYGSRIRTFRNQAKNSQWDNEEIDLTKAYKAFFAK

HGINIYDNIKEAIAMETEKSFFEDLLHLLKLTLQMRNSITGTTTDYLISPVHDSKGNFYDS

RICDNSLPANADANGAYNIARKGLMLIQQIKDSTSSNRFKFSPITNKDWLIFAQEKPYLN

D

>WP_024988992_(modified) hypothetical protein
[Prevotella albensis]
                                                                (SEQ ID NO: 97)
MNIKNFTGLYPLSKTLRFELKPIGKTKENIEKNGILTKDEQRAKDYLIVKGFIDEYHKQFI

KDRLWDFKLPLESEGEKNSLEEYQELYELTKRNDAQEADFTEIKDNLRSSITEQLTKSGS
```

-continued

AYDRIFKKEFIREDLVNFLEDEKDKNIVKQFEDFTTYFTGFYENRKNMYSSEEKSTAIAY

RLIHQNLPKFMDNMRSFAKIANSSVSERFSDIYESWKEYLNVNSIEEIFQLDYFSETLTQP

HIEVYNYIIGKKVLEDGTEIKGINEYVNLYNQQQKDKSKRLPFLVPLYKQILSDREKLSWI

AEEFDSDKKMLSAITESYNHLHNVLMGNENESLRNLLLNIKDYNLEKINITNDLSLTEISQ

NLFGRYDVFTNGIKNKLRVLTPRKKKETDENFEDRINKIFKTQKSFSIAFLNKLPQPEME

DGKPRNIEDYFITQGAINTKSIQKEDIFAQIENAYEDAQVFLQIKDTDNKLSQNKTAVEKI

KTLLDALKELQHFIKPLLGSGEENEKDELFYGSFLAIWDELDTITPLYNKVRNWLTRKPY

STEKIKLNFDNAQLLGGWDVNKEHDCAGILLRKNDSYYLGIINKKTNHIFDTDITPSDGE

CYDKIDYKLLPGANKMLPKVFFSKSRIKEFEPSEAIINCYKKGTHKKGKNFNLTDCHRLI

NFFKTSIEKHEDWSKFGFKFSDTETYEDISGFYREVEQQGYRLTSHPVSASYIHSLVKEG

KLYLFQIWNKDFSQFSKGTPNLHTLYWKMLFDKRNLSDVVYKLNGQAEVFYRKSSIEH

QNRIIHPAQHPITNKNELNKKHTSTFKYDIIKDRRYTVDKFQFHVPITINFKATGQNNINPI

VQEVIRQNGITHIIGIDRGERHLLYLSLIDLKGNIIKQMTLNEIINEYKGVTYKTNYHNLLE

KREKERTEARHSWSSIESIKELKDGYMSQVIHKITDMMVKYNAIVVLEDLNGGFMRGR

QKVEKQVYQKFEKKLIDKLNYLVDKKLDANEVGGVLNAYQLTNKFESFKKIGKQSGFL

FYIPAWNTSKIDPITGFVNLFNTRYESIKETKVFWSKFDIIRYNKEKNWFEFVFDYNTFTT

KAEGTRTKWTLCTHGTRIQTFRNPEKNAQWDNKEINLTESFKALFEKYKIDITSNLKEST

MQETEKKFFQELHNLLHLTLQMRNSVTGTDIDYLISPVADEDGNFYDSRINGKNFPENA

DANGAYNIARKGLMLIRQIKQADPQKKFKFETITNKDWLKFAQDKPYLKD

>WP_039658684_(modified) hypothetical protein
[Smithella sp. SC_K08D17]

(SEQ ID NO: 98)

MQTLFENFTNQYPVSKTLRFELIPQGKTKDFIEQKGLLKKDEDRAEKYKKVKNIIDEYHK

DFIEKSLNGLKLDGLEKYKTLYLKQEKDDKDKKAFDKEKENLRKQIANAFRNNEKFKT

LFAKELIKNDLMSFACEEDKKNVKEFEAFTTYFTGFHQNRANMYVADEKRTAIASRLIH

ENLPKFIDNIKIFEKMKKEAPELLSPFNQTLKDMKDVIKGTTLEEIFSLDYFNKTLTQSGID

IYNSVIGGRTPEEGKTKIKGLNEYINTDFNQKQTDKKKRQPKFKQLYKQILSDRQSLSFIA

EAFKNDTEILEAIEKFYVNELLHFSNEGKSTNVLDAIKNAVSNLESFNLTKMYFRSGASL

TDVSRKVFGEWSIINRALDNYYATTYPIKPREKSEKYEERKEKWLKQDFNVSLIQTAIDE

YDNETVKGKNSGKVIADYFAKFCDDKETDLIQKVNEGYIAVKDLLNTPCPENEKLGSNK

DQVKQIKAFMDSIMDIMHFVRPLSLKDTDKEKDETFYSLFTPLYDHLTQTIALYNKVRN

YLTQKPYSTEKIKLNFENSTLLGGWDLNKETDNTAIILRKDNLYYLGIMDKRHNRIFRNV

PKADKKDFCYEKMVYKLLPGANKMLPKVFFSQSRIQEFTPSAKLLENYANETHKKGDN

FNLNHCHKLIDFFKDSINKHEDWKNFDFRFSATSTYADLSGFYHEVEHQGYKISFQSVA

DSFIDDLVNEGKLYLFQIYNKDFSPFSKGKPNLHTLYWKMLFDENNLKDVVYKLNGEA

EVFYRKKSIAEKNTTIHKANESIINKNPDNPKATSTFNYDIVKDKRYTIDKFQFHIPITMNF

KAEGIFNMNQRVNQFLKANPDINIIGIDRGERHLLYYALINQKGKILKQDTLNVIANEKQ

KVDYHNLLDKKEGDRATARQEWGVIETIKELKEGYLSQVIHKLTDLMIENNAIIVMEDL

NFGFKRGRQKVEKQVYQKFEKMLIDKLNYLVDKNKKANELGGLLNAFQLANKFESFQ

KMGKQNGFIFYVPAWNTSKTDPATGFIDFLKPRYENLNQAKDFFEKFDSIRLNSKADYF

EPAFDFKNFTEKADGGRTKWTVCTTNEDRYAWNRALNNNRGSQEKYDITAELKSLFDG

KVDYKSGKDLKQQIASQESADFFKALMKNLSITLSLRHNNGEKGDNEQDYILSPVADSK

```
GRFFDSRKADDDMPKNADANGAYHIALKGLWCLEQISKTDDLKKVKLAISNKEWLEFV

QTLKG
```

>WP_037385181_(modified) hypothetical protein
[*Smithella* sp. SCADC]
(SEQ ID NO: 99)

```
MQTLFENFTNQYPVSKTLRFELIPQGKTKDFIEQKGLLKKDEDRAEKYKKVKNIIDEYHK

DFIEKSLNGLKLDGLEEYKTLYLKQEKDDKDKKAFDKEKENLRKQIANAFRNNEKFKTL

FAKELIKNDLMSFACEEDKKNVKEFEAFTTYFTGFHQNRANMYVADEKRTAIASRLIHE

NLPKFIDNIKIFEKMKKEAPELLSPFNQTLKDMKDVIKGTTLEEIFSLDYFNKTLTQSGIDI

YNSVIGGRTPEEGKTKIKGLNEYINTDFNQKQTDKKKRQPKFKQLYKQILSDRQSLSFIA

EAFKNDTEILEAIEKFYVNELLHFSNEGKSTNVLDAIKNAVSNLESFNLTKIYFRSGTSLT

DVSRKVFGEWSIINRALDNYYATTYPIKPREKSEKYEERKEKWLKQDFNVSLIQTAIDEY

DNETVKGKNSGKVIVDYFAKFCDDKETDLIQKVNEGYIAVKDLLNTPYPENEKLGSNK

DQVKQIKAFMDSIMDIMHFVRPLSLKDTDKEKDETFYSLFTPLYDHLTQTIALYNKVRN

YLTQKPYSTEKIKLNFENSTLLGGWDLNKETDNTAIILRKENLYYLGIMDKRHNRIFRNV

PKADKKDSCYEKMVYKLLPGANKMLPKVFFSQSRIQEFTPSAKLLENYENETHKKGDN

FNLNHCHQLIDFFKDSINKHEDWKNFDFRFSATSTYADLSGFYHEVEHQGYKISFQSIAD

SFIDDLVNEGKLYLFQIYNKDFSPFSKGKPNLHTLYWKMLFDENNLKDVVYKLNGEAE

VFYRKKSIAEKNTTIHKANESIINKNPDNPKATSTFNYDIVKDKRYTIDKFQFHVPITMNF

KAEGIFNMNQRVNQFLKANPDINIIGIDRGERHLLYYTLINQKGKILKQDTLNVIANEKQ

KVDYHNLLDKKEGDRATARQEWGVIETIKELKEGYLSQVIHKLTDLMIENNAIIVMEDL

NFGFKRGRQKVEKQVYQKFEKMLIDKLNYLVDKNKKANELGGLLNAFQLANKFESFQ

KMGKQNGFIFYVPAWNTSKTDPATGFIDFLKPRYENLKQAKDFFEKFDSIRLNSKADYF

EFAFDFKNFTGKADGGRTKWTVCTTNEDRYAWNRALNNNRGSQEKYDITAELKSLFD

GKVDYKSGKDLKQQIASQELADFFRTLMKYLSVTLSLRHNNGEKGETEQDYILSPVADS

MGKFFDSRKAGDDMPKNADANGAYHIALKGLWCLEQISKTDDLKKVKLAISNKEWLE

FMQTLKG
```

>WP_039871282_(modified) hypothetical protein
[*Prevotella bryantii*]
(SEQ ID NO: 100)

```
MKFTDFTGLYSLSKTLRFELKPIGKTLENIKKAGLLEQDQHRADSYKKVKKIIDEYHKAF

IEKSLSNFELKYQSEDKLDSLEEYLMYYSMKRIEKTEKDKFAKIQDNLRKQIADHLKGD

ESYKTIFSKDLIRKNLPDFVKSDEERTLIKEFKDFTTYFKGFYENRENMYSAEDKSTAISH

RIIHENLPKFVDNINAFSKIILIPELREKLNQIYQDFEEYLNVESIDEIFHLDYFSMVMTQKQ

IEVYNAIIGGKSTNDKKIQGLNEYINLYNQKHKDCKLPKLKLLFKQILSDRIAISWLPDNF

KDDQEALDSIDTCYKNLLNDGNVLGEGNLKLLLENIDTYNLKGIFIRNDLQLTDISQKM

YASWNVIQDAVILDLKKQVSRKKKESAEDYNDRLKKLYTSQESFSIQYLNDCLRAYGK

TENIQDYFAKLGAVNNEHEQTINLFAQVRNAYTSVQAILTTPYPENANLAQDKETVALI

KNLLDSLKRLQRFIKPLLGKGDESDKDERFYGDFTPLWETLNQITPLYNMVRNYMTRKP

YSQEKIKLNFENSTLLGGWDLNKEHDNTAIILRKNGLYYLAIMKKSANKIFDKDKLDNS

GDCYEKMVYKLLPGANKMLPKVFFSKSRIDEFKPSENIIENYKKGTHKKGANFNLADCH

NLIDFFKSSISKHEDWSKFNFHFSDTSSYEDLSDFYREVEQQGYSISFCDVSVEYINKMVE

KGDLYLFQIYNKDFSEFSKGTPNMHTLYWNSLFSKENLNNIIYKLNGQAEIFFRKKSLNY

KRPTHPAHQAIKNKNKCNEKKESIFDYDLVKDKRYTVDKFQFHVPITMNFKSTGNTNIN
```

-continued

QQVIDYLRTEDDTHIIGIDRGERHLLYLVVIDSHGKIVEQFTLNEIVNEYGGNIYRTNYHD

LLDTREQNREKARESWQTIENIKELKEGYISQVIHKITDLMQKYHAVVVLEDLNMGFMR

GRQKVEKQVYQKFEEMLINKLNYLVNKKADQNSAGGLLHAYQLTSKFESFQKLGKQS

GFLFYIPAWNTSKIDPVTGFVNLFDTRYESIDKAKAFFGKFDSIRYNADKDWFEFAFDYN

NFTTKAEGTRTNWTICTYGSRIRTFRNQAKNSQWDNEEIDLTKAYKAFFAKHGINIYDNI

KEAIAMETEKSFFEDLLHLLKLTLQMRNSITGTTTDYLISPVHDSKGNFYDSRICDNSLPA

NADANGAYNIARKGLMLIQQIKDSTSSNRFKFSPITNKDWLIFAQEKPYLND

>EKE28449_(modified) hypothetical protein ACD_3C00058G0015 [uncultured bacterium (gcode 4)]
(SEQ ID NO: 101)
MFKGDAFTGLYEVQKTLRFELVPIGLTQSYLENDWVIQKDKEVEENYGKIKAYFDLIHK

EFVRQSLENAWLCQLDDFYEKYIELHNSLETRKDKNLAKQFEKVMKSLKKEFVSFFDA

KWNEWKQKFSFLKKWWIDVLNEKEVLDLMAEFYPDEKELFDKFDKFFTYFSNFKESRK

NFYADDGRAWAIATRAIDENLITFIKNIEDFKKLNSSFREFVNDNFSEEDKQIFEIDFYNN

CLLQPWIDKYNKIVWWYSLENWEKVQWLNEKINNFKQNQNKSNSKDLKFPRMKLLYK

QILGDKEKKVYIDEIRDDKNLIDLIDNSKRRNQIKIDNANDIINDFINNNAKFELDKIYLTR

QSINTISSKYFSSWDYIRWYFWTGELQEFVSFYDLKETFWKIEYETLENIFKDCYVKGINT

ESQNNIVFETQGIYENFLNIFKFEFNQNISQISLLEWELDKIQNEDIKKNEKQVEVIKNYFD

SVMSVYKMTKYFSLEKWKKRVELDTDNNFYNDFNEYLEGFEIWKDYNLVRNYITKKQ

VNTDKIKLNFDNSQFLTWWDKDKENERLGIILRREWKYYLWILKKWNTLNFGDYLQKE

WEIFYEKMNYKQLNNVYRQLPRLLFPLTKKLNELKWDELKKYLSKYIQNFWYNEEIAQI

KIEFDIFQESKEKWEKFDIDKLRKLIEYYKKWVLALYSDLYDLEFIKYKNYDDLSIFYSD

VEKKMYNLNFTKIDKSLIDGKVKSWELYLFQIYNKDFSESKKEWSTENIHTKYFKLLFN

EKNLQNLVVKLSWWADIFFRDKTENLKFKKDKNGQEILDHRRFSQDKIMFHISITLNAN

CWDKYWFNQYVNEYMNKERDIKIIWIDRWEKHLAYYCVIDKSWKIFNNEIWTLNELN

WVNYLEKLEKIESSRKDSRISWWEIENIKELKNGYISQVINKLTELIVKYNAIIVFEDLNIW

FKRWRQKIEKQIYQKLELALAKKLNYLTQKDKKDDEILWNLKALQLVPKVNDYQDIW

NYKQSWIMFYVRANYTSVTCPNCWLRKNLYISNSATKENQKKSLNSIAIKYNDWKFSFS

YEIDDKSWKQKQSLNKKKFIVYSDIERFVYSPLEKLTKVIDVNKKLLELFRDFNLSLDIN

KQIQEKDLDSVFFKSLTHLFNLILQLRNSDSKDNKDYISCPSCYYHSNNWLQWFEFNWD

ANWAYNIARKGIILLDRIRKNQEKPDLYVSDIDWDNFVQSNQFPNTIIPIQNIEKQVPLNI

KI

>WP_018359861_(modified) hypothetical protein [Porphyromonas macacae]
(SEQ ID NO: 102)
MKTQHFFEDFTSLYSLSKTIRFELKPIGKTLENIKKNGLIRRDEQRLDDYEKLKKVIDEYH

EDFIANILSSFSFSEEILQSYIQNLSESEARAKIEKTMRDTLAKAFSEDERYKSIFKKELVK

KDIPVWCPAYKSLCKKFDNFTTSLVPFHENRKNLYTSNEITASIPYRIVHVNLPKFIQNIE

ALCELQKKMGADLYLEMMENLRNVWPSFVKTPDDLCNLKTYNHLMVQSSISEYNRFV

GGYSTEDGTKHQGINEWINIYRQRNKEMRLPGLVFLHKQILAKVDSSSFISDTLENDDQV

FCVLRQFRKLFWNTVSSKEDDAASLKDLFCGLSGYDPEAIYVSDAHLATISKNIFDRWN

YISDAIRRKTEVLMPRKKESVERYAEKISKQIKKRQSYSLAELDDLLAHYSEESLPAGFSL

LSYFTSLGGQKYLVSDGEVILYEEGSNIWDEVLIAFRDLQVILDKDFTEKKLGKDEEAVS

```
VIKKALDSALRLRKFFDLLSGTGAEIRRDSSFYALYTDRMDKLKGLLKMYDKVRNYLT

KKPYSIEKFKLHFDNPSLLSGWDKNKELNNLSVIFRQNGYYYLGIIVITPKGKNLFKTLPK

LGAEEMFYEKMEYKQIAEPMLMLPKVFFPKKTKPAFAPDQSVVDIYNKKTFKTGQKGF

NKKDLYRLIDFYKEALTVHEWKLFNFSFSPTEQYRNIGEFFDEVREQAYKVSMVNVPAS

YIDEAVENGKLYLFQIYNKDFSPYSKGIPNLHTLYWKALFSEQNQSRVYKLCGGGELFY

RKASLHMQDTTVHPKGISIHKKNLNKKGETSLFNYDLVKDKRFTEDKFFFHVPISINYKN

KKITNVNQMVRDYIAQNDDLQIIGIDRGERNLLYISRIDTRGNLLEQFSLNVIESDKGDLR

TDYQKILGDREQERLRRRQEWKSIESIKDLKDGYMSQVVHKICNMVVEHKAIVVLENL

NLSFMKGRKKVEKSVYEKFERMLVDKLNYLVVDKKNLSNEPGGLYAAYQLTNPLFSFE

ELHRYPQSGILFFVDPWNTSLTDPSTGFVNLLGRINYTNVGDARKFFDRFNAIRYDGKG

NILFDLDLSRFDVRVETQRKLWTLTTFGSRIAKSKKSGKWMVERIENLSLCFLELFEQFNI

GYRVEKDLKKAILSQDRKEFYVRLIYLFNLMMQIRNSDGEEDYILSPALNEKNLQFDSRL

IEAKDLPVDADANGAYNVARKGLMVVQRIKRGDHESIHRIGRAQWLRYVQEGIVE

>WP_013282991_(modified) hypothetical protein
[Butyrivibrio proteoclasticus]
                                              (SEQ ID NO: 103)
MLLYENYTKRNQITKSLRLELRPQGKTLRNIKELNLLEQDKAIYALLERLKPVIDEGIKDI

ARDTLKNCELSFEKLYEHFLSGDKKAYAKESERLKKEIVKTLIKNLPEGIGKISEINSAKY

LNGVLYDFIDKTHKDSEEKQNILSDILETKGYLALFSKFLTSRITTLEQSMPKRVIENFEIY

AANIPKMQDALERGAVSFAIEYESICSVDYYNQILSQEDIDSYNRLISGIMDEDGAKEKGI

NQTISEKNIKIKSEHLEEKPFRILKQLHKQILEEREKAFTIDHIDSDEEVVQVTKEAFEQTK

EQWENIKKINGFYAKDPGDITLFIVVGPNQTHVLSQLIYGEHDRIRLLLEEYEKNTLEVLP

RRTKSEKARYDKFVNAVPKKVAKESHTFDGLQKMTGDDRLFILYRDELARNYMRIKEA

YGTFERDILKSRRGIKGNRDVQESLVSFYDELTKFRSALRIINSGNDEKADPIFYNTFDGIF

EKANRTYKAENLCRNYVTKSPADDARIMASCLGTPARLRTHWWNGEENFAINDVAMIR

RGDEYYYFVLTPDVKPVDLKTKDETDAQIFVQRKGAKSFLGLPKALFKCILEPYFESPEH

KNDKNCVIEEYVSKPLTIDRRAYDIFKNGTFKKTNIGIDGLTEEKFKDDCRYLIDVYKEFI

AVYTRYSCFNMSGLKRADEYNDIGEFFSDVDTRLCTMEWIPVSFERINDMVDKKEGLLF

LVRSMFLYNRPRKPYERTFIQLFSDSNMEHTSMLLNSRAMIQYRAASLPRRVTHKKGSIL

VALRDSNGEHIPMHIREAIYKMKNNFDISSEDFIIVIAKAYLAEHDVAIKKANEDIIRNRRY

TEDKFFLSLSYTKNADISARTLDYINDKVEEDTQDSRMAVIVTRNLKDLTYVAVVDEKN

NVLEEKSLNEIDGVNYRELLKERTKIKYHDKTRLWQYDVSSKGLKEAYVELAVTQISKL

ATKYNAVVVESMSSTFKDKFSFLDEQIFKAFEARLCARMSDLSFNTIKEGEAGSISNPIQ

VSNNNGNSYQDGVIYFLNNAYTRTLCPDTGFVDVFDKTRLITMQSKRQFFAKMKDIRID

DGEMLFTFNLEEYPTKRLLDRKEWTVKIAGDGSYFDKDKGEYVYVNDIVREQIIPALLE

DKAVFDGNMAEKFLDKTAISGKSVELIYKWFANALYGIITKKDGEKIYRSPITGTEIDVS

KNTTYNFGKKFMFKQEYRGDGDFLDAFLNYMQAQDIAV

>AIZ56868_(modified) hypothetical protein Mpt1_c09950
[Candidatus Methanoplasma termitum]
                                              (SEQ ID NO: 104)
MNNYDEFTKLYPIQKTIRFELKPQGRTMEHLETFNFFEEDRDRAEKYKILKEAIDEYHKK

FIDEHLTNMSLDWNSLKQISEKYYKSREEKDKKVFLSEQKRMRQEIVSEFKKDDRFKDL

FSKKLFSELLKEEIYKKGNHQEIDALKSFDKFSGYFIGLHENRKNMYSDGDEITAISNRIV

NENFPKFLDNLQKYQEARKKYPEWIIKAESALVAHNIKMDEVFSLEYFNKVLNQEGIQR
```

-continued

YNLALGGYVTKSGEKMMGLNDALNLAHQSEKSSKGRIHMTPLFKQILSEKESFSYIPDV

FTEDSQLLPSIGGFFAQIENDKDGNIFDRALELISSYAEYDTERIYIRQADINRVSNVIFGE

WGTLGGLMREYKADSINDINLERTCKKVDKWLDSKEFALSDVLEAIKRTGNNDAFNEY

ISKMRTAREKIDAARKEMKFISEKISGDEESIHIIKTLLDSVQQFLHFFNLFKARQDIPLDG

AFYAEFDEVHSKLFAIVPLYNKVRNYLTKNNLNTKKIKLNFKNPTLANGWDQNKVYDY

ASLIFLRDGNYYLGIINPKRKKNIKFEQGSGNGPFYRKMVYKQIPGPNKNLPRVFLTSTK

GKKEYKPSKEIIEGYEADKHIRGDKFDLDFCHKLIDFFKESIEKHKDWSKFNFYFSPTESY

GDISEFYLDVEKQGYRMHFENISAETIDEYVEKGDLFLFQIYNKDFVKAATGKKDMHTI

YWNAAFSPENLQDVVVKLNGEAELFYRDKSDIKEIVHREGEILVNRTYNGRTPVPDKIH

KKLTDYHNGRTKDLGEAKEYLDKVRYFKAHYDITKDRRYLNDKIYFHVPLTLNFKANG

KKNLNKMVIEKFLSDEKAHIIGIDRGERNLLYYSIIDRSGKIIDQQSLNVIDGFDYREKLN

QREIEMKDARQSWNAIGKIKDLKEGYLSKAVHEITKMAIQYNAIVVMEELNYGFKRGRF

KVEKQIYQKFENMLIDKMNYLVFKDAPDESPGGVLNAYQLTNPLESFAKLGKQTGILFY

VPAAYTSKIDPTTGFVNLFNTSSKTNAQERKEFLQKFESISYSAKDGGIFAFAFDYRKFGT

SKTDHKNVWTAYTNGERMRYIKEKKRNELFDPSKEIKEALTSSGIKYDGGQNILPDILRS

NNNGLIYTMYSSFIAAIQMRVYDGKEDYIISPIKNSKGEFFRTDPKRRELPIDADANGAY

NIALRGELTMRAIAEKFDPDSEKMAKLELKHKDWFEFMQTRGD

>WP_027407524_(modified) hypothetical protein
[Anaerovibrio sp. RM50]
(SEQ ID NO: 105)
MVAFIDEFVGQYPVSKTLRFEARPVPETKKWLESDQCSVLFNDQKRNEYYGVLKELLD

DYYRAYIEDALTSFTLDKALLENAYDLYCNRDTNAFSSCCEKLRKDLVKAFGNLKDYL

LGSDQLKDLVKLKAKVDAPAGKGKKKIEVDSRLINWLNNNAKYSAEDREKYIKAIESFE

GFVTYLTNYKQARENMFSSEDKSTAIAFRVIDQNMVTYFGNIRIYEKIKAKYPELYSALK

GFEKFFSPTAYSEILSQSKIDEYNYQCIGRPIDDADFKGVNSLINEYRQKNGIKARELPVM

SMLYKQILSDRDNSFMSEVINRNEEAIECAKNGYKVSYALFNELLQLYKKIFTEDNYGNI

YVKTQPLTELSQALFGDWSILRNALDNGKYDKDIINLAELEKYFSEYCKVLDADDAAKI

QDKFNLKDYFIQKNALDATLPDLDKITQYKPHLDAMLQAIRKYKLFSMYNGRKKMDVP

ENGIDFSNEFNAIYDKLSEFSILYDRIRNFATKKPYSDEKMKLSFNMPTMLAGWDYNNE

TANGCFLFIKDGKYFLGVADSKSKNIFDFKKNPHLLDKYSSKDIYYKVKYKQVSGSAK

MLPKVVFAGSNEKIFGHLISKRILEIREKKLYTAAAGDRKAVAEWIDFMKSAIAIHPEWN

EYFKFKFKNTAEYDNANKFYEDIDKQTYSLEKVEIPTEYIDEMVSQHKLYLFQLYTKDFS

DKKKKKGTDNLHTMYWHGVFSDENLKAVTEGTQPIIKLNGEAEMFMRNPSIEFQVTHE

HNKPIANKNPLNTKKESVFNYDLIKDKRYTERKFYFHCPITLNFRADKPIKYNEKINRFV

ENNPDVCIIGIDRGERHLLYYTVINQTGDILEQGSLNKISGSYTNDKGEKVNKETDYHDL

LDRKEKGKHVAQQAWETIENIKELKAGYLSQVVYKLTQLMLQYNAVIVLENLNVGFKR

GRTKVEKQVYQKFEKAMIDKLNYLVFKDRGYEMNGSYAKGLQLTDKFESFDKIGKQT

GCIYYVIPSYTSHIDPKTGFVNLLNAKLRYENITKAQDTIRKFDSISYNAKADYFEFAFDY

RSFGVDMARNEWVVCTCGDLRWEYSAKTRETKAYSVTDRLKELFKAHGIDYVGGENL

VSHITEVADKHFLSTLLFYLRLVLKMRYTVSGTENENDFILSPVEYAPGKFFDSREATST

EPMNADANGAYHIALKGLMTIRGIEDGKLHNYGKGGENAAWFKFMQNQEYKNNG

-continued

>WP_044910712_(modified) hypothetical protein
[*Lachnospiraceae bacterium* MC2017]
(SEQ ID NO: 106)
MDYGNGQFERRAPLTKTITLRLKPIGETRETIREQKLLEQDAAFRKLVETVTPIVDDCIRK

IADNALCHFGTEYDFSCLGNAISKNDSKAIKKETEKVEKLLAKVLTENLPDGLRKVNDIN

SAAFIQDTLTSFVQDDADKRVLIQELKGKTVLMQRFLTTRITALTVWLPDRVFENFNIFIE

NAEKMRILLDSPLNEKIMKFDPDAEQYASLEFYGQCLSQKDIDSYNLIISGIYADDEVKN

PGINEIVKEYNQQIRGDKDESPLPKLKKLHKQILMPVEKAFFVRVLSNDSDARSILEKILK

DTEMLPSKIIEAMKEADAGDIAVYGSRLHELSHVIYGDHGKLSQIIYDKESKRISELMETL

SPKERKESKKRLEGLEEHIRKSTYTFDELNRYAEKNVMAAYIAAVEESCAEIMRKEKDL

RTLLSKEDVKIRGNRHNTLIVKNYFNAWTVFRNLIRILRRKSEAEIDSDFYDVLDDSVEV

LSLTYKGENLCRSYITKKIGSDLKPEIATYGSALRPNSRWWSPGEKFNVKFHTIVRRDGR

LYYFILPKGAKPVELEDMDGDIECLQMRKIPNPTIFLPKLVFKDPEAFFRDNPEADEFVFL

SGMKAPVTITRETYEAYRYKLYTVGKLRDGEVSEEEYKRALLQVLTAYKEFLENRMIY

ADLNFGFKDLEEYKDSSEFIKQVETHNTFMCWAKVSSSQLDDLVKSGNGLLFEIWSERL

ESYYKYGNEKVLRGYEGVLLSILKDENLVSMRTLLNSRPMLVYRPKESSKPMVVHRDG

SRVVDRFDKDGKYIPPEVHDELYRFFNNLLIKEKLGEKARKILDNKKVKVKVLESERVK

WSKFYDEQFAVTFSVKKNADCLDTTKDLNAEVMEQYSESNRLILIRNTTDILYYLVLDK

NGKVLKQRSLNIINDGARDVDWKERFRQVTKDRNEGYNEWDYSRTSNDLKEVYLNYA

LKEIAEAVIEYNAILBEKMSNAFKDKYSFLDDVTFKGFETKLLAKLSDLHFRGIKDGEPC

SFTNPLQLCQNDSNKILQDGVIFMVPNSMTRSLDPDTGFIFAINDHNIRTKKAKLNFLSKF

DQLKVSSEGCLIMKYSGDSLPTHNTDNRVWNCCCNHPITNYDRETKKVEFIEEPVEELS

RVLEENGIETDTELNKLNERENVPGKVVDAIYSLVLNYLRGTVSGVAGQRAVYYSPVTG

KKYDISFIQAMNLRKCDYYRIGSKERGEWTDFVAQLIN

>WP_027216152_(modified) hypothetical protein
[*Butyrivibrio fibrisolvens*]
(SEQ ID NO: 107)
MYYESLTKLYPIKKTIRNELVPIGKTLENIKKNNILEADEDRKIAYIRVKAIMDDYHKRLI

NEALSGFALIDLDKAANLYLSRSKSADDIESFSRFQDKLRKAIAKRLREHENFGKIGNKDI

IPLLQKLSENEDDYNALESFKNFYTYFESYNDVRLNLYSDKEKSSTVAYRLINENLPRFL

DNIRAYDAVQKAGITSEELSSEAQDGLFLVNTFNNVLIQDGINTYNEDIGKLNVAINLYN

QKNASVQGFRKVPKMKVLYKQILSDREESFIDEFESDTELLDSLESHYANLAKYFGSNK

VQLLFTALRESKGVNVYVKNDIAKTSFSNVVFGSWSRIDELINGEYDDNNNRKKDEKY

YDKRQKELKKNKSYTIEKIITLSTEDVDVIGKYIEKLESDIDDIRFKGKNFYEAVLCGHDR

SKKLSKNKGAVEAIKGYLDSVKDFERDLKLINGSGQELEKNLVVYGEQEAVLSELSGID

SLYNMTRNYLTKKPFSTEKIKLNFNKPTFLDGWDYGNEEAYLGFFMIKEGNYFLAVMD

ANWNKEFRNIPSVDKSDCYKKVIYKQISSPEKSIQNLMVIDGKTVKKNGRKEKEGIHSGE

NLILEELKNTYLPKKINDIRKRRSYLNGDTFSKKDLTEFIGYYKQRVIEYYNGYSFYFKSD

DDYASFKEFQEDVGRQAYQISYVDVPVSFVDDLINSGKLYLFRVYNKDFSEYSKGRLNL

HTLYFKMLFDERNLKNVVYKLNGQAEVFYRPSSIKKEELIVHRAGEEIKNKNPKRAAQK

PTRRLDYDIVKDRRYSQDKFMLHTSIIMNFGAEENVSFNDIVNGVLRNEDKVNVIGIDRG

ERNLLYVVVIDPEGKILEQRSLNCITDSNLDIETDYHRLLDEKESDRKIARRDWTTIENIK

ELKAGYLSQVVHIVAELVLKYNAIICLEDLNFGFKRGRQKVEKQVYQKFEKMLIDKLNY

-continued

LVMDKSREQLSPEKISGALNALQLTPDFKSFKVLGKQTGIIYYVPAYLTSKIDPMTGFAN

LFYVKYENVDKAKEFFSKFDSIKYNKDGKNWNTKGYFEFAFDYKKFTDRAYGRVSEW

TVCTVGERIIKFKNKEKNNSYDDKVIDLTNSLKELFDSYKVTYESEVDLKDAILAIDDPA

FYRDLTRRLQQTLQMRNSSCDGSRDYIISPVKNSKGEFFCSDNNDDTTPNDADANGAFN

IARKGLWVLNEIRNSEEGSKINLAMSNAQWLEYAQDNTI

>WP_016301126_(modified) hypothetical protein
[Lachnospiraceae bacterium COE1]
(SEQ ID NO: 108)

MHENNGKIADNFIGIYPVSKTLRFELKPVGKTQEYIEKHGILDEDLKRAGDYKSVKKIID

AYHKYFIDEALNGIQLDGLKNYYELYEKKRDNNEEKEFQKIQMSLRKQIVKRFSEHPQY

KYLFKKELIKNVLPEFTKDNAEEQTLVKSFQEFTTYFEGFHQNRKNMYSDEEKSTAIAY

RVVHQNLPKYIDNMRIFSMILNTDIRSDLTELFNNLKTKMDITIVEEYFAIDGFNKVVNQ

KGIDVYNTILGAFSTDDNTKIKGLNEYINLYNQKNKAKLPKLKPLFKQILSDRDKISFIPE

QFDSDTEVLEAVDMFYNRLLQFVIENEGQITISKLLTNFSAYDLNKIYVKNDTTISAISND

LFDDWSYISKAVRENYDSENVDKNKRAAAYEEKKEKALSKIKMYSIEELNFFVKKYSC

NECHIEGYFERRILEILDKMRYAYESCKILHDKGLINNISLCQDRQAISELKDFLDSIKEVQ

WLLKPLMIGQEQADKEEAFYTELLRIWEELEPITLLYNKVRNYVTKKPYTLEKVKLNFY

KSTLLDGWDKNKEKDNLGIILLKDGQYYLGIMNRRNNKIADDAPLAKTDNVYRKMEY

KLLTKVSANLPRIFLKDKYNPSEEMLEKYEKGTHLKGENFCIDDCRELIDFFKKGIKQYE

DWGQFDFKFSDTESYDDISAFYKEVEHQGYKITFRDIDETYIDSLVNEGKLYLFQIYNKD

FSPYSKGTKNLHTLYWEMLFSQQNLQNIVYKLNGNAEIFYRKASINQKDVVVHKADLPI

KNKDPQNSKKESMFDYDIIKDKRFTCDKYQFHVPITMNFKALGENHFNRKVNRLIHDAE

NMHIIGIDRGERNLIYLCMIDMKGNIVKQISLNEIISYDKNKLEHKRNYHQLLKTREDEN

KSARQSWQTIHTIKELKEGYLSQVIHVITDLMVEYNAIVVLEDLNFGFKQGRQKFERQV

YQKFEKMLIDKLNYLVDKSKGMDEDGGLLHAYQLTDEFKSFKQLGKQSGFLYYIPAWN

TSKLDPTTGFVNLFYTKYESVEKSKEFINNFTSILYNQEREYFEFLFDYSAFTSKAEGSRL

KWTVCSKGERVETYRNPKKNNEWDTQKIDLTFELKKLFNDYSISLLDGDLREQMGKID

KADFYKKFMKLFALIVQMRNSDEREDKLISPVLNKYGAFFETGKNERMPLDADANGAY

NIARKGLWIIEKIKNTDVEQLDKVKLTISNKEWLQYAQEHIL

>WP_035635841_(modified) hypothetical protein
[Lachnospiraceae bacterium ND2006]
(SEQ ID NO: 109)

MSKLEKFTNCYSLSKTLRFKAIPVGKTQENIDNKRLLVEDEKRAEDYKGVKKLLDRYYL

SFINDVLHSIKLKNLNNYISLFRKKTRTEKENKELENLEINLRKEIAKAFKGNEGYKSLFK

KDIIETILPEFLDDKDEIALVNSFNGFTTAFTGFFDNRENMFSEEAKSTSIAFRCINENLTR

YISNMDIFEKVDAIFDKHEVQEIKEKILNSDYDVEDFFEGEFFNFVLTQEGIDVYNAIIGGF

VTESGEKIKGLNEYINLYNQKTKQKLPKFKPLYKQVLSDRESLSFYGEGYTSDEEVLEVF

RNTLNKNSEIFSSIKKLEKLFKNFDEYSSAGIFVKNGPAISTISKDIFGEWNVIRDKWNAE

YDDIHLKKKAVVTEKYEDDRRKSFKKIGSFSLEQLQEYADADLSVVEKLKEIIIQKVDEI

YKVYGSSEKLFDADFVLEKSLKKNDAVVAIMKDLLDSVKSFENYIKAFFGEGKETNRDE

SFYGDFVLAYDILLKVDHIYDAIRNYVTQKPYSKDKFKLYFQNPQFMGGWDKDKETDY

RATILRYGSKYYLAIMDKKYAKCLQKIDKDDVNGNYEKINYKLLPGPNKMLPKVFFSK

KWMAYYNPSEDIQKIYKNGTFKKGDMFNLNDCHKLIDFFKDSISRYPKWSNAYDFNFS

ETEKYKDIAGFYREVEEQGYKVSFESASKKEVDKLVEEGKLYMFQIYNKDFSDKSHGTP

NLHTMYFKLLFDENNHGQIRLSGGAELFMRRASLKKEELVVHPANSPIANKNPDNPKKT

TTLSYDVYKDKRFSEDQYELHIPIAINKCPKNIFKINTEVRVLLKHDDNPYVIGIDRGERN

LLYIVVVDGKGNIVEQYSLNEIINNFNGIRIKTDYHSLLDKKEKERFEARQNWTSIENIKE

LKAGYISQVVHKICELVEKYDAVIALEDLNSGFKNSRVKVEKQVYQKFEKMLIDKLNY

MVDKKSNPCATGGALKGYQITNKFESFKSMSTQNGFIFYIPAWLTSKIDPSTGFVNLLKT

KYTSIADSKKFISSFDRIIVIYVPEEDLFEFALDYKNFSRTDADYIKKWKLYSYGNRIRIFRN

PKKNNVFDWEEVCLTSAYKELFNKYGINYQQGDIRALLCEQSDKAFYSSFMALMSLML

QMRNSITGRTDVDFLISPVKNSDGIFYDSRNYEAQENAILPKNADANGAYNIARKVLWA

IGQFKKAEDEKLDKVKIAISNKEWLEYAQTSVKH

>WP_015504779_(modified) exonuclease SbcC [*Candidatus Methanomethylophilus alvus*]
(SEQ ID NO: 110)
MDAKEFTGQYPLSKTLRFELRPIGRTWDNLEASGYLAEDRHRAECYPRAKELLDDNHR

AFLNRVLPQIDMDWHPIAEAFCKVHKNPGNKELAQDYNLQLSKRRKEISAYLQDADGY

KGLFAKPALDEAMKIAKENGNESDIEVLEAFNGFSVYFTGYHESRENIYSDEDMVSVAY

RITEDNFPRFVSNALIFDKLNESHPDIISEVSGNLGVDDIGKYFDVSNYNNFLSQAGIDDY

NHIIGGHTTEDGLIQAFNVVLNLRHQKDPGFEKIQFKQLYKQILSVRTSKSYIPKQFDNSK

EMVDCICDYVSKIEKSETVERALKLVRNISSFDLRGIFVNKKNLRILSNKLIGDWDAIETA

LMHSSSSENDKKSVYDSAEAFTLDDIFSSVKKFSDASAEDIGNRAEDICRVISETAPFIND

LRAVDLDSLNDDGYEAAVSKIRESLEPYMDLFHELEIFSVGDEFPKCAAFYSELEEVSEQ

LIEIIPLFNKARSFCTRKRYSTDKIKVNLKFPTLADGWDLNKERDNKAAILRKDGKYYLA

ILDMKKDLSSIRTSDEDESSFEKMEYKLLPSPVKMLPKIFVKSKAAKEKYGLTDRMLEC

YDKGMHKSGSAFDLGFCHELIDYYKRCIAEYPGWDVFDFKFRETSDYGSMKEFNEDVA

GAGYYMSLRKIPCSEVYRLLDEKSIYLFQIYNKDYSENAHGNKNMHTMYWEGLFSPQN

LESPVFKLSGGAELFFRKSSIPNDAKTVHPKGSVLVPRNDVNGRRIPDSIYRELTRYFNRG

DCRISDEAKSYLDKVKTKKADHDIVKDRRFTVDKMMFHVPIAMNFKAISKPNLNKKVI

DGIIDDQDLKIIGIDRGERNLIYVTMVDRKGNILYQDSLNILNGYDYRKALDVREYDNKE

ARRNWTKVEGIRKMKEGYLSLAVSKLADMIIENNAIIVMEDLNHGFKAGRSKIEKQVYQ

KFESMLINKLGYMVLKDKSIDQSGGALHGYQLANHVTTLASVGKQCGVIFYIPAAFTSK

IDPTTGFADLFALSNVKNVASMREFFSKMKSVIYDKAEGKFAFTFDYLDYNVKSECGRT

LWTVYTVGERFTYSRVNREYVRKVPTDIIYDALQKAGISVEGDLRDRIAESDGDTLKSIF

YAFKYALDMRVENREEDYIQSPVKNASGEFFCSKNAGKSLPQDSDANGAYNIALKGILQ

LRMLSEQYDPNAESIRLPLITNKAWLTFMQSGMKTWKN

>WP_044910713_(modified) hypothetical protein [*Lachnospiraceae bacterium* MC2017]
(SEQ ID NO: 111)
MGLYDGFVNRYSVSKTLRFELIPQGRTREYIETNGILSDDEERAKDYKTIKRLIDEYHKD

YISRCLKNVNISCLEEYYHLYNSSNRDKRHEELDALSDQMRGEIASFLTGNDEYKEQKS

RDIIINERIINFASTDEELAAVKRFRKFTSYFTGFFTNRENMYSAEKKSTAIAHRIIDVNLP

KYVDNIKAFNTAIEAGVFDIAEFESNFKAITDEHEVSDLLDITKYSRFIRNEDIIIYNTLLGG

ISMKDEKIQGLNELINLHNQKHPGKKVPLLKVLYKQILGDSQTHSFVDDQFEDDQQVIN

AVKAVTDTFSETLLGSLKIIINNIGHYDLDRIYIKAGQDITTLSKRALNDWHIITECLESEY

DDKFPKNKKSDTYEEMRNRYVKSFKSFSIGRLNSLVTTYTEQACFLENYLGSFGGDTDK

```
NCLTDFTNSLMEVEHLLNSEYPVTNRLITDYESVRILKRLLDSEMEVIHFLKPLLGNGNE

SDKDLVFYGEFEAEYEKLLPVIKVYNRVRNYLTRKPFSTEKIKLNFNSPTLLCGWSQSKE

KEYMGVILRKDGQYYLGIIVITPSNKKIFSEAPKPDEDCYEKMVLRYIPHPYQMLPKVFFS

KSNIAFFNPSDEILRIKKQESFKKGKSFNRDDCHKFIDFYKDSINRHEEWRKFNFKFSDTD

SYEDISRFYKEVENQAFSMSFTKIPTVYIDSLVDEGKLYLFKLHNKDFSEHSKGKPNLHT

VYWNALFSEYNLQNTVYQLNGSAEIFFRKASIPENERVIHKKNVPITRKVAELNGKKEVS

VFPYDIIKNRRYTVDKFQFHVPLKMNFKADEKKRINDDVIEAIRSNKGIHVIGIDRGERNL

LYLSLINEEGRIIEQRSLNIIDSGEGHTQNYRDLLDSREKDREKARENWQEIQEIKDLKTG

YLSQAIHTITKWMKEYNAIIVLEDLNDRFTNGRKKVEKQVYQKFEKMLIDKLNYYVDK

DEEFDRMGGTHRALQLTEKFESFQKLGRQTGFIFYVPAWNTSKLDPTTGFVDLLYPKYK

SVDATKDFIKKFDFIRFNSEKNYFEFGLHYSNFTERAIGCRDEWILCSYGNRIVNFRNAA

KNNSWDYKEIDITKQLLDLFEKNGIDVKQENLIDSICEMKDKPFFKSLIANIKLILQIRNSA

SGTDIDYMISPAMNDRGEFFDTRKGLQQLPLDADANGAYNIAKKGLWIVDQIRNTTGN

NVKMAMSNREWMHFAQESRLA
```

>KKQ36153_(modified) hypothetical protein US52_C0007G0008
[candidate division WS6 bacterium GW2011_GWA2_37_6]
(SEQ ID NO: 112)

```
MKNVFGGFTNLYSLTKTLRFELKPTSKTQKLMKRNNVIQTDEEIDKLYHDEMKPILDEIH

RRFINDALAQKIFISASLDNFLKVVKNYKVESAKKNIKQNQVKLLQKEITIKTLGLRREV

VSGFITVSKKWKDKYVGLGIKLKGDGYKVLTEQAVLDILKIEFPNKAKYIDKFRGFWTY

FSGFNENRKNYYSEEDKATSIANRIVNENLSRYIDNIIAFEEILQKIPNLKKFKQDLDITSY

NYYLNQAGIDKYNKIIGGYIVDKDKKIQGINEKVNLYTQQTKKKLPKLKFLFKQIGSERK

GFGIFEIKEGKEWEQLGDLFKLQRTKINSNGREKGLFDSLRTMYREFFDEIKRDSNSQAR

YSLDKIYFNKASVNTISNSWFTNWNKFAELLNIKEDKKNGEKKIPEQISIEDIKDSLSIIPK

ENLEELFKLTNREKHDRTRFFGSNAWVTFLNIWQNEIEESFNKLEEKEKDFKKNAAIKFQ

KNNLVQKNYIKEVCDRMLAIERMAKYHLPKDSNLSREEDFYWIIDNLSEQREIYKYYNA

FRNYISKKPYNKSKMKLNFENGNLLGGWSDGQERNKAGVILRNGNKYYLGVLINRGIF

RTDKINNEIYRTGSSKWERLILSNLKFQTLAGKGFLGKHGVSYGNMNPEKSVPSLQKFIR

ENYLKKYPQLTEVSNTKFLSKKDFDAAIKEALKECFTMNFINIAENKLLEAEDKGDLYLF

EITNKDFSGKKSGKDNIHTIYWKYLFSESNCKSPIIGLNGGAEIFFREGQKDKLHTKLDKK

GKKVFDAKRYSEDKLFFHVSITINYGKPKNIKFRDIINQLITSMNVNIIGIDRGEKHLLYYS

VIDSNGIILKQGSLNKIRVGDKEVDFNKKLTERANEMKKARQSWEQIGNIKNFKEGYLS

QAIHEIYQLMIKYNAIIVLEDLNTEFKAKRLSKVEKSVYKKFELKLARKLNHLILKDRNT

NEIGGVLKAYQLTPTIGGGDVSKFEKAKQWGMMFYVRANYTSTTDPVTGWRKHLYISN

FSNNSVIKSFFDPTNRDTGIEIFYSGKYRSWGFRYVQKETGKKWELFATKELERFKYNQT

TKLCEKINLYDKFEELFKGIDKSADIYSQLCNVLDFRWKSLVYLWNLLNQIRNVDKNAE

GNKNDFIQSPVYPFFDSRKTDGKTEPINGDANGALNIARKGLMLVERIKNNPEKYEQLIR

DTEWDAWIQNFNKVN
```

>WP_044919442_(modified) hypothetical protein
[*Lachnospiraceae bacterium* MA2020]
(SEQ ID NO: 113)

```
MYYESLTKQYPVSKTIRNELIPIGKTLDNIRQNNILESDVKRKQNYEHVKGILDEYHKQLI

NEALDNCTLPSLKIAAEIYLKNQKEVSDREDFNKTQDLLRKEVVEKLKAHENFTKIGKK

DILDLLEKLPSISEDDYNALESFRNFYTYFTSYNKVRENLYSDKEKSSTVAYRLINENFPK
```

-continued

FLDNVKSYRFVKTAGILADGLGEEEQDSLFIVETFNKTLTQDGIDTYNSQVGKINSSINLY

NQKNQKANGFRKIPKMKMLYKQILSDREESFIDEFQSDEVLIDNVESYGSVLIESLKSSK

VSAFFDALRESKGKNVYVKNDLAKTAMSNIVFENWRTFDDLLNQEYDLANENKKKDD

KYFEKRQKELKKNKSYSLEHLCNLSEDSCNLIENYIHQISDDIENIIINNETFLRIVINEHDR

SRKLAKNRKAVKAIKDFLDSIKVLERELKLINSSGQELEKDLIVYSAHEELLVELKQVDS

LYNMTRNYLTKKPFSTEKVKLNFNRSTLLNGWDRNKETDNLGVLLLKDGKYYLGIMN

TSANKAFVNPPVAKTEKVFKKVDYKLLPVPNQMLPKVFFAKSNIDFYNPSSEIYSNYKK

GTHKKGNMFSLEDCHNLIDFFKESISKHEDWSKFGFKFSDTASYNDISEFYREVEKQGY

KLTYTDIDETYINDLIERNELYLFQIYNKDFSMYSKGKLNLHTLYFMMLFDQRNIDDVV

YKLNGEAEVFYRPASISEDELIIHKAGEEIKNKNPNRARTKETSTFSYDIVKDKRYSKDKF

TLHIPITMNFGVDEVKRFNDAVNSAIRIDENVNVIGIDRGERNLLYVVVIDSKGNILEQISL

NSIIINKEYDIETDYHALLDEREGGRDKARKDWNTVENIRDLKAGYLSQVVNVVAKLVL

KYNAIICLEDLNFGFKRGRQKVEKQVYQKFEKMLIDKLNYLVIDKSREQTSPKELGGAL

NALQLTSKFKSFKELGKQSGVIYYVPAYLTSKIDPTTGFANLFYMKCENVEKSKRFFDGF

DFIRFNALENVFEFGFDYRSFTQRACGINSKWTVCTNGERIIKYRNPDKNNMFDEKVVV

VTDEMKNLFEQYKIPYEDGRNVKDMIISNEEAEFYRRLYRLLQQTLQMRNSTSDGTRDY

IISPVKNKREAYFNSELSDGSVPKDADANGAYNIARKGLWVLEQIRQKSEGEKINLAMT

NAEWLEYAQTHLL

>WP_035798880_(modified) hypothetical protein
[*Butyrivibrio* sp. NC3005]
(SEQ ID NO: 114)
MYYQNLTKKYPVSKTIRNELIPIGKTLENIRKNNILESDVKRKQDYEHVKGIMDEYHKQ

LINEALDNYMLPSLNQAAEIYLKKHVDVEDREEFKKTQDLLRREVTGRLKEHENYTKIG

KKDILDLLEKLPSISEEDYNALESFRNFYTYFTSYNKVRENLYSDEEKSSTVAYRLINENL

PKFLDNIKSYAFVKAAGVLADCIEEEEQDALFMVETFNMTLTQEGIDMYNYQIGKVNSA

INLYNQKNHKVEEFKKIPKMKVLYKQILSDREEVFIGEFKDDETLLSSIGAYGNVLMTYL

KSEKINIFFDALRESEGKNVYVKNDLSKTTMSNIVFGSWSAFDELLNQEYDLANENKKK

DDKYFEKRQKELKKNKSYTLEQMSNLSKEDISPIENYIERISEDIEKICIYNGEFEKIVVNE

HDSSRKLSKNIKAVKVIKDYLDSIKELEHDIKLINGSGQELEKNLVVYVGQEEALEQLRP

VDSLYNLTRNYLTKKPFSTEKVKLNFNKSTLLNGWDKNKETDNLGILFFKDGKYYLGI

MNTTANKAFVNPPAAKTENVFKKVDYKLLPGSNKMLPKVFFAKSNIGYYNPSTELYSN

YKKGTHKKGPSFSIDDCHNLIDFFKESIKKHEDWSKFGFEFSDTADYRDISEFYREVEKQ

GYKLTFTDIDESYINDLIEKNELYLFQIYNKDFSEYSKGKLNLHTLYFMMLFDQRNLDNV

VYKLNGEAEVFYRPASIAENELVIHKAGEGIKNKNPNRAKVKETSTFSYDIVKDKRYSK

YKFTLHIPITMNFGVDEVRRFNDVINNALRTDDNVNVIGIDRGERNLLYVVVINSEGKIL

EQISLNSIINKEYDIETNYHALLDEREDDRNKARKDWNTIENIKELKTGYLSQVVNVVAK

LVLKYNAIICLEDLNFGFKRGRQKVEKQVYQKFEKMLIEKLNYLVIDKSREQVSPEKMG

GALNALQLTSKFKSFAELGKQSGIIYYVPAYLTSKIDPTTGFVNLFYIKYENIEKAKQFFD

GFDFIRFNKKDDNIFEFSFDYKSFTQKACGIRSKWIVYTNGERIIKYPNPEKNNLFDEKVIN

VTDEIKGLFKQYRIPYENGEDIKEIIISKAEADFYKRLFRLLHQTLQMRNSTSDGTRDYIIS

PVKNDRGEFFCSEFSEGTMPKDADANGAYNIARKGLWVLEQIRQKDEGEKVNLSMTNA

EWLKYAQLHLL

>WP_027109509_(modified) hypothetical protein
[*Lachnospiraceae bacterium* NC2008]

(SEQ ID NO: 788)

MENYYDSLTRQYPVTKTIRQELKPVGKTLENIKNAEIIEADKQKKEAYVKVKELMDEFHKSIIEK

SLVGIKLDGLSEFEKLYKIKTKTDEDKNRISELFYYMRKQIADALKNSRDYGYVDNKDLIEKILPE

RVKDENSLNALSCFKGFTTYFTDYYKNRKNIYSDEEKHSTVGYRCINENLLIFMSNIEVYQIYKK

ANIKNDNYDEETLDKTFMIESFNECLTQSGVEAYNSVVASIKTATNLYIQKNNKEENFVRVPKM

KVLFKQILSDRTSLFDGLIIESDDELLDKLCSFSAEVDKFLPINIDRYIKTLMDSNNGTGIYVKNDS

SLTTLSNYLTDSWSSIRNAFNENYDAKYTGKVNDKYEEKREKAYKSNDSFELNYIQNLLGINVID

KYIERINFDIKEICEAYKEMTKNCFEDHDKTKKLQKNIKAVASIKSYLDSLKNIERDIKLLNGTGL

ESRNEFFYGEQSTVLEEITKVDELYNITRNYLTKKPFSTEKMKLNFNNPQLLGGWDVNKERDCY

GVILIKDNNYYLGIMDKSANKSFLNIKESKNENAYKKVNCKLLPGPNKMFPKVFFAKSNIDYYDP

THEIKKLYDKGTFKKGNSFNLEDCHKLIDFYKESIKKNDDWKNFNFNFSDTKDYEDISGFFREVE

AQNYKITYTNVSCDFIESLVDEGKLYLFQIYNKDFSEYATGNLNLHTLYLKMLFDERNLKDLCIK

MNGEAEVFYRPASILDEDKVVHKANQKITNKNTNSKKKESIFSYDIVKDKRYTVDKFFIHLPITLN

YKEQNVSRFNDYIREILKKSKNIRVIGIDRGERNLLYVVVCDSDGSILYQRSINEIVSGSHKTDYH

KLLDNKEKERLSSRRDWKTIENIKDLKAGYMSQVVNEIYNLILKYNAIVVLEDLNIGFKNGRKK

VEKQVYQNFEKALIDKLNYLCIDKTREQLSPSSPGGVLNAYQLTAKFESFEKIGKQTGCIFYVPA

YLTSQIDPTTGFVNLFYQKDTSKQGLQLFFRKFKKINFDKVASNFEFVFDYNDFTNKAEGTKTN

WTISTQGTRIAKYRSDDANGKWISRTVHPTDIIKEALNREKINYNDGHDLIDEIVSIEKSAVLKEIY

YGFKLTLQLRNSTLANEEEQEDYIISPVKNSSGNYFDSRITSKELPCDADANGAYNIARKGLWAL

EQIRNSENVSKVKLAISNKEWFEYTQNNIPSL

>WP_029202018_(modified) hypothetical protein
[*Oribacterium* sp. NK2B42]

(SEQ ID NO: 115)

MYYDGLTKQYALSKTIRNELVPIGKTLDNIKKNRILEADIKRKSDYEHVKKLMDMYHK

KIINEALDNFKLSVLEDAADIYFNKQNDERDIDAFLKIQDKLRKEIVEQLKGHTDYSKVG

NKDFLGLLKAASTEEDRILIESFDNFYTYFTSYNKVRSNLYSAEDKSSTVAYRLINENLPK

FFDNIKAYRTVRNAGVISGDMSIVEQDELFEVDTFNHTLTQYGIDTYNHMIGQLNSAINL

YNQKMHGAGSFKKLPKMKELYKQLLTEREEEFIEEYTDDEVLITSVHNYVSYLIDYLNS

DKVESFFDTLRKSDGKEVFIKNDVSKTTMSNILFDNWSTIDDLINHEYDSAPENVKKTKD

DKYFEKRQKDLKKNKSYSLSKIAALCRDTTILEKYIRRLVDDIEKIYTSNNVFSDIVLSKH

DRSKKLSKNTNAVQAIKNMLDSIKDFEHDVMLINGSGQEIKKNLNVYSEQEALAGILRQ

VDHIYNLTRNYLTKKPFSTEKIKLNFNRPTFLDGWDKNKEEANLGILLIKDNRYYLGIMN

TSSNKAFVNPPKAISNDIYKKVDYKLLPGPNKMLPKVFFATKNIAYYAPSEELLSKYRKG

THKKGDSFSIDDCRNLIDFFKSSINKNTDWSTFGFNFSDTNSYNDISDFYREVEKQGYKL

SFTDIDACYIKDLVDNNELYLFQIYNKDFSPYSKGKLNLHTLYFKMLFDQRNLDNVVYK

LNGEAEVFYRPASIESDEQIIHKSGQNIKNKNQKRSNCKKTSTFDYDIVKDRRYCKDKFM

LHLPITVNFGTNESGKFNELVNNAIRADKDVNVIGIDRGERNLLYVVVVDPCGKIIEQISL

NTIVDKEYDIETDYHQLLDEKEGSRDKARKDWNTIENIKELKEGYLSQVVNIIAKLVLKY

DAIICLEDLNFGFKRGRQKVEKQVYQKFEKMLIDKMNYLVLDKSRKQESPQKPGGALN

ALQLTSAFKSFKELGKQTGIIYYVPAYLTSKIDPTTGFANLFYIKYESVDKARDFFSKFDFI

RYNQMDNYFEFGFDYKSFTERASGCKSKWIACTNGERIVKYRNSDKNNSFDDKTVILTD

-continued

EYRSLFDKYLQNYIDEDDLKDQILQIDSADFYKNLIKLFQLTLQMRNSSSDGKRDYIISPV

KNYREEFFCSEFSDDTFPRDADANGAYNIARKGLWVIKQIRETKSGTKINLAMSNSEWL

EYAQCNLL

>WP_028248456_(modified) hypothetical protein
[*Pseudobutyrivibrio ruminis*]
(SEQ ID NO: 116)
MYYQNLTKMYPISKTLRNELIPVGKTLENIRKNGILEADIQRKADYEHVKKLMDNYHK

QLINEALQGVHLSDLSDAYDLY

FNLSKEKNSVDAFSKCQDKLRKEIVSLLKNHENFPKIGNKEIIKLLQSLYDNDTDYKALD

SFSNFYTYFSSYNEVRKNLYSDEEKSSTVAYRLINENLPKFLDNIKAYAIAKKAGVRAEG

LSEEDQDCLFIIETFERTLTQDGIDNYNAAIGKLNTAINLFNQQNKKQEGFRKVPQMKCL

YKQILSDREEAFIDEFSDDEDLITNIESFAENMNVFLNSEIITDFKIALVESDGSLVYIKNDV

SKTSFSNIVFGSWNAIDEKLSDEYDLANSKKKKDEKYYEKRQKELKKNKSYDLETIIGLF

DDNSDVIGKYIEKLESDITAIAEAKNDFDEIVLRKHDKNKSLRKNTNAVEAIKSYLDTVK

DFERDIKLINGSGQEVEKNLVVYAEQENILAEIKNVDSLYNMSRNYLTQKPFSTEKFKLN

FNRATLLNGWDKNKETDNLGILFEKDGMYYLGIMNTKANKIFVNIPKATSNDVYHKVN

YKLLPGPNKMLPKVFFAQSNLDYYKPSEELLAKYKAGTHKKGDNFSLEDCHALIDFFK

ASIEKHPDWSSFGFEFSETCTYEDLSGFYREVEKQGYKITYTDVDADYITSLVERDELYL

FQIYNKDFSPYSKGNLNLHTIYLQMLFDQRNLNNVVYKLNGEAEVFYRPASINDEEVIIH

KAGEEIKNKNSKRAVDKPTSKFGYDIIKDRRYSKDKFMLHIPVTMNFGVDETRRFNDVV

NDALRNDEKVRVIGIDRGERNLLYVVVVDTDGTILEQISLNSIINNEYSIETDYHKLLDEK

EGDRDRARKNWTTIENIKELKEGYLSQVVNVIAKLVLKYNAIICLEDLNFGFKRGRQKV

EKQVYQKFEKMLIDKLNYLVIDKSRKQDKPEEFGGALNALQLTSKFTSFKDMGKQTGII

YYVPAYLTSKIDPTTGFANLFYVKYENVEKAKEFFSRFDSISYNNESGYFEFAFDYKKFT

DRACGARSQWTVCTYGERIIKFRNTEKNNSFDDKTIVLSEEFKELFSIYGISYEDGAELKN

KIMSVDEADFFRSLTRLFQQTMQMRNSSNDVTRDYIISPIMNDRGEFFNSEACDASKPKD

ADANGAFNIARKGLWVLEQIRNTPSGDKLNLAMSNAEWLEYAQRNQI

>WP_028830240_(modified) hypothetical protein
[*Proteocatella sphenisci*]
(SEQ ID NO: 117)
MENFKNLYPINKTLRFELRPYGKTLENFKKSGLLEKDAFKANSRRSMQAIIDEKFKETIE

ERLKYTEFSECDLGNMTSKDKKITDKAATNLKKQVILSFDDEIFNNYLKPDKNIDALFKN

DPSNPVISTFKGFTTYFVNFFEIRKHIFKGESSGSMAYRIIDENLTTYLNNIEKIKKLPEELK

SQLEGIDQIDKLNNYNEFITQSGITHYNEIIGGISKSENVKIQGINEGINLYCQKNKVKLPR

LTPLYKMILSDRVSNSFVLDTIENDTELIEMISDLINKTEISQDVIMSDIQNIFIKYKQLGNL

PGISYSSIVNAICSDYDNNFGDGKRKKSYENDRKKHLETNVYSINYISELLTDTDVSSNIK

MRYKELEQNYQVCKENFNATNWMNIKNIKQSEKTNLIKDLLDILKSIQRFYDLFDIVDE

DKNPSAEFYTWLSKNAEKLDFEFNSVYNKSRNYLTRKQYSDKKIKLNFDSPTLAKGWD

ANKEIDNSTIIIVIRKFNNDRGDYDYFLGIWNKSTPANEKIIPLEDNGLFEKMQYKLYPDPS

KMLPKQFLSKIWKAKHPTTPEFDKKYKEGREIKKGPDFEKEFLHELIDCFKHGLVNHDE

KYQDVFGFNLRNTEDYNSYTEFLEDVERCNYNLSFNKIADTSNLINDGKLYVFQIWSKD

FSIDSKGTKNLNTIYFESLFSEENMIEKMFKLSGEAEIFYRPASLNYCEDIIKKGHHHAEL

KDKFDYPIIKDKRYSQDKFFFHVPMVINYKSEKLNSKSLNNRTNENLGQFTHIIGIDRGER

HLIYLTVVDVSTGEIVEQKHLDEIINTDTKGVEHKTHYLNKLEEKSKTRDNERKSWEAIE

-continued

```
TIKELKEGYISHVINEIQKLQEKYNALIVMENLNYGFKNSRIKVEKQVYQKFETALIKKF

NYIIDKKDPETYIEGYQLTNPITTLDKIGNQSGIVLYIPAWNTSKIDPVTGFVNLLYADDL

KYKNQEQAKSFIQKIDNIYFENGEFKFDIDFSKWNNRYSISKTKWTLTSYGTRIQTFRNP

QKNNKWDSAEYDLTEEFKLILNIDGTLKSQDVETYKKFMSLFKLMLQLRNSVTGTDIDY

MISPVTDKTGTHFDSRENIKNLPADADANGAYNIARKGIMAIENIMNGISDPLKISNEDYL

KYIQNQQE
```

Applicants generated vector constructs as shown in FIGS. 3A-L (e.g. PACYC184 fnCpf1 (PY001)) and FIGS. 4A-E (e.g. PaCpf1).

Figure 1A:
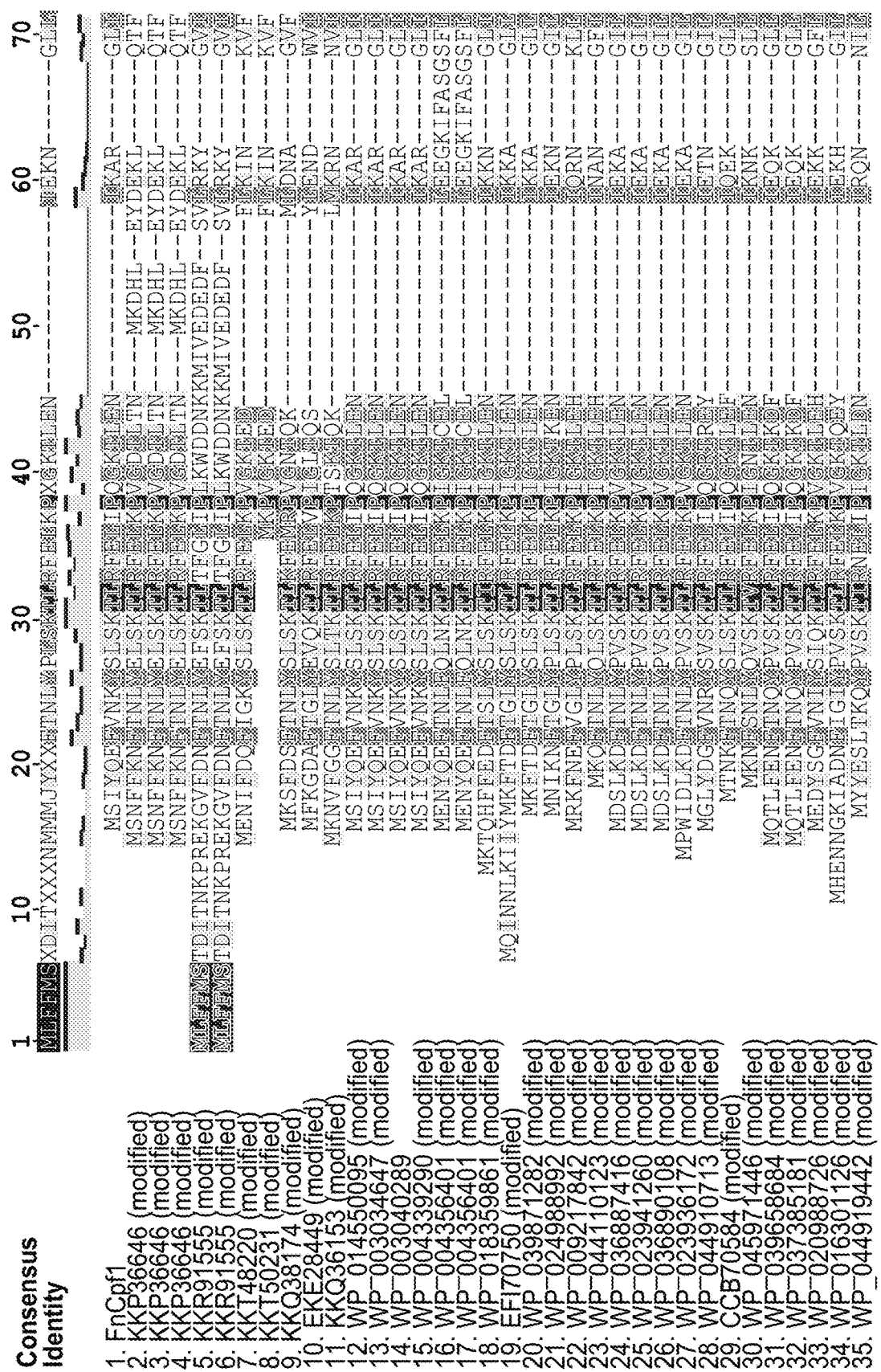
FIGS. 1A-1BB show the sequence alignment of Cas-Cpf1 orthologs (SEQ ID NOS 294-351, respectively, in order of appearance).
Figure 1B:
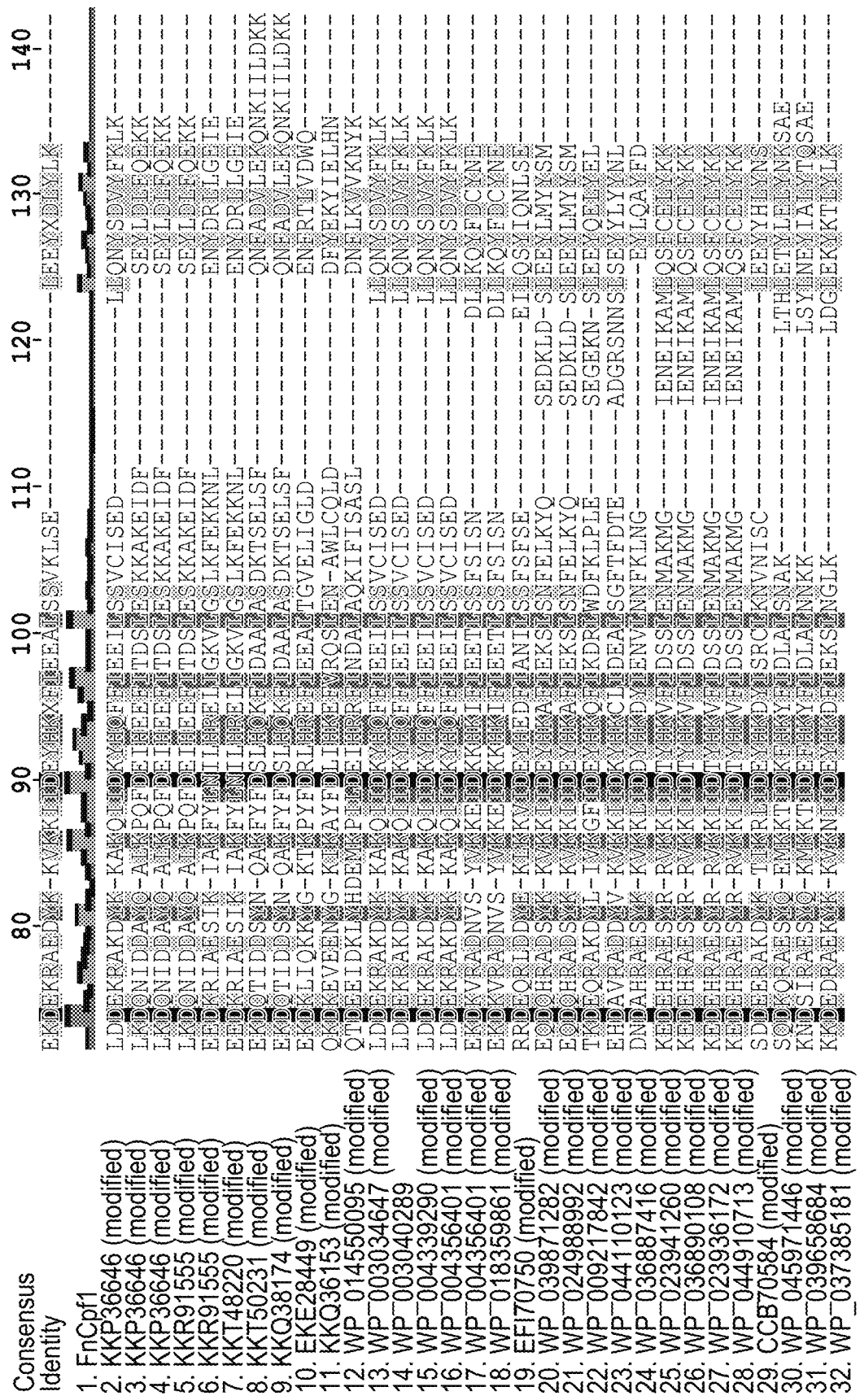
Figure 1E:
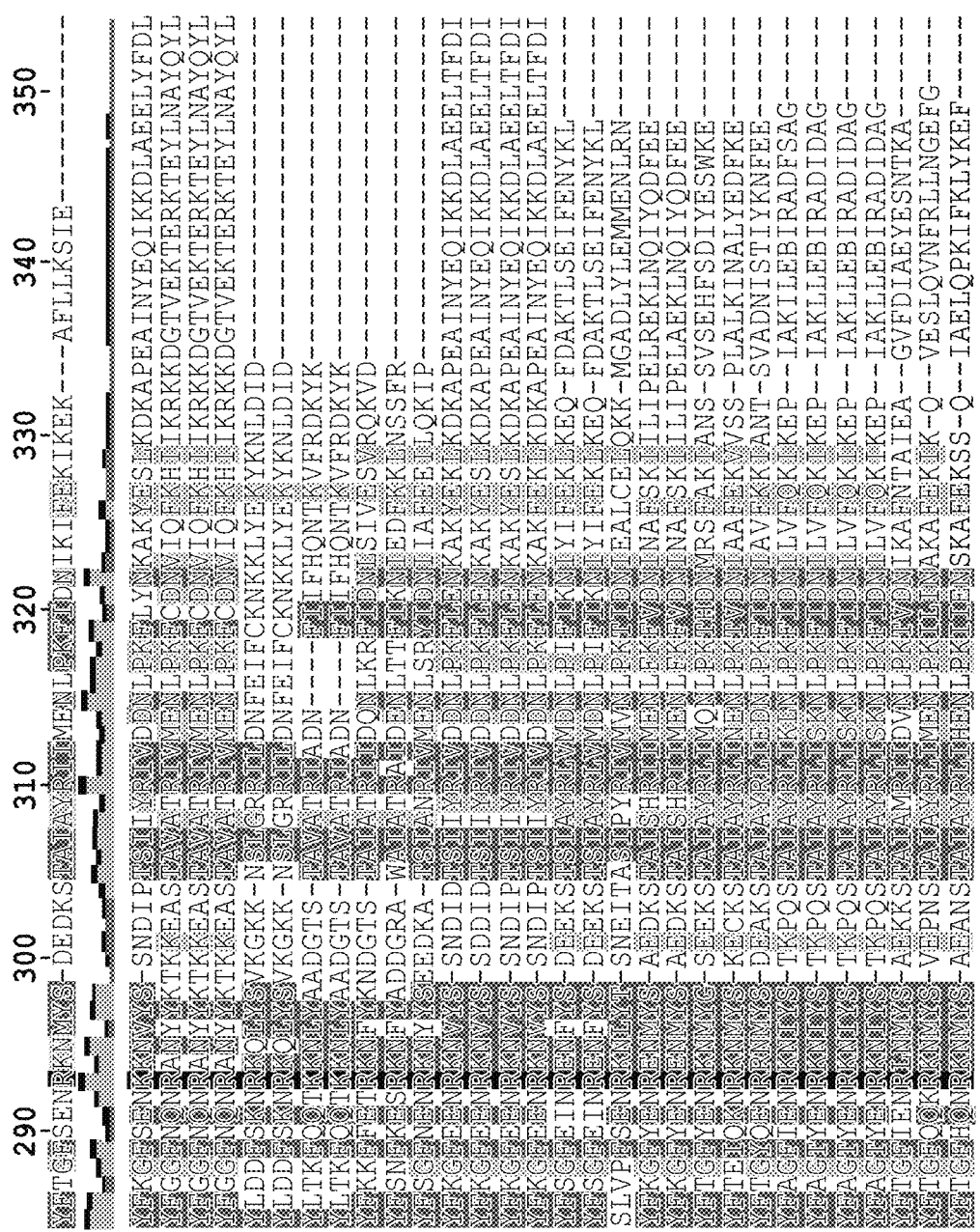
Figure 1F:
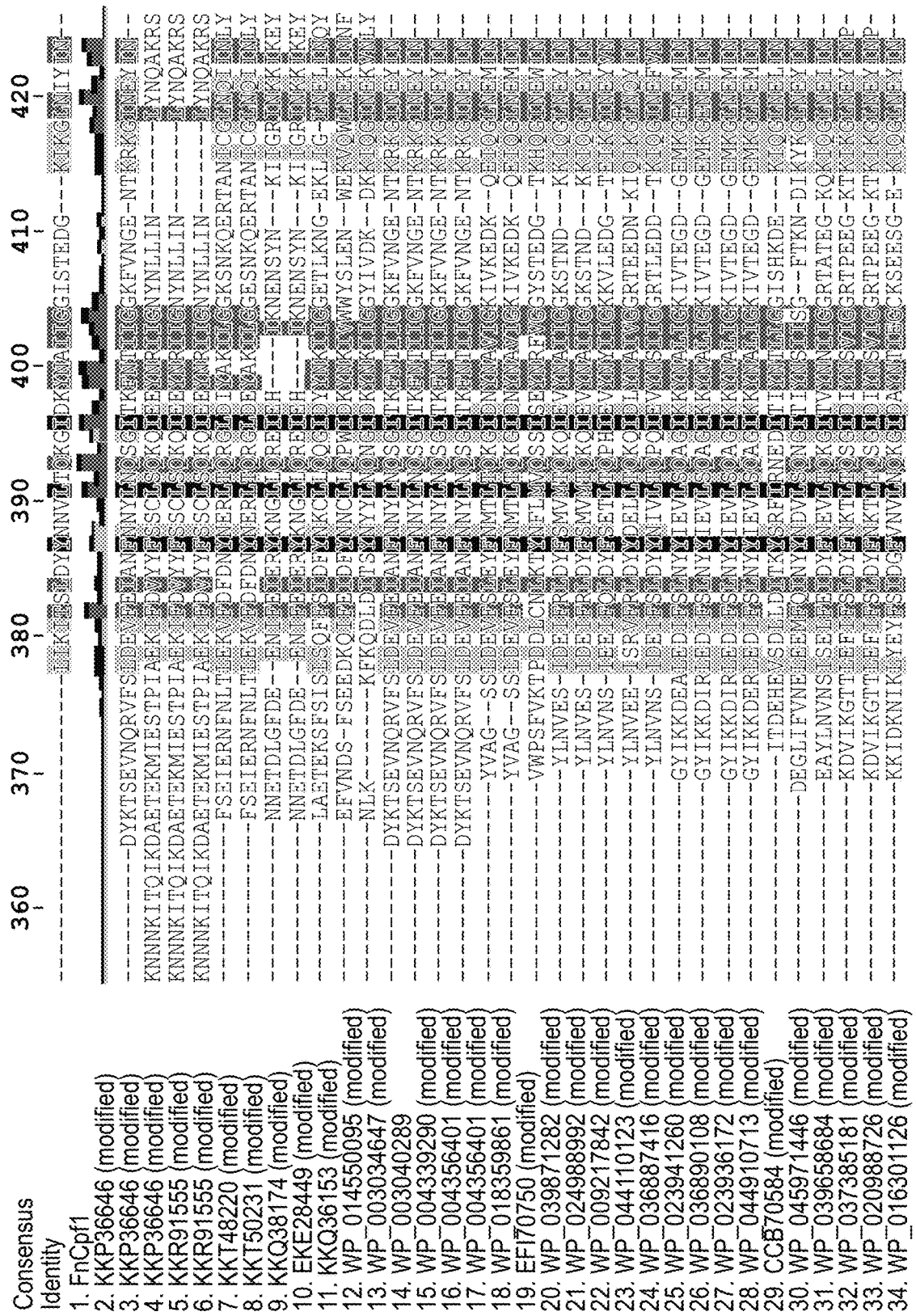
Figure 1J:
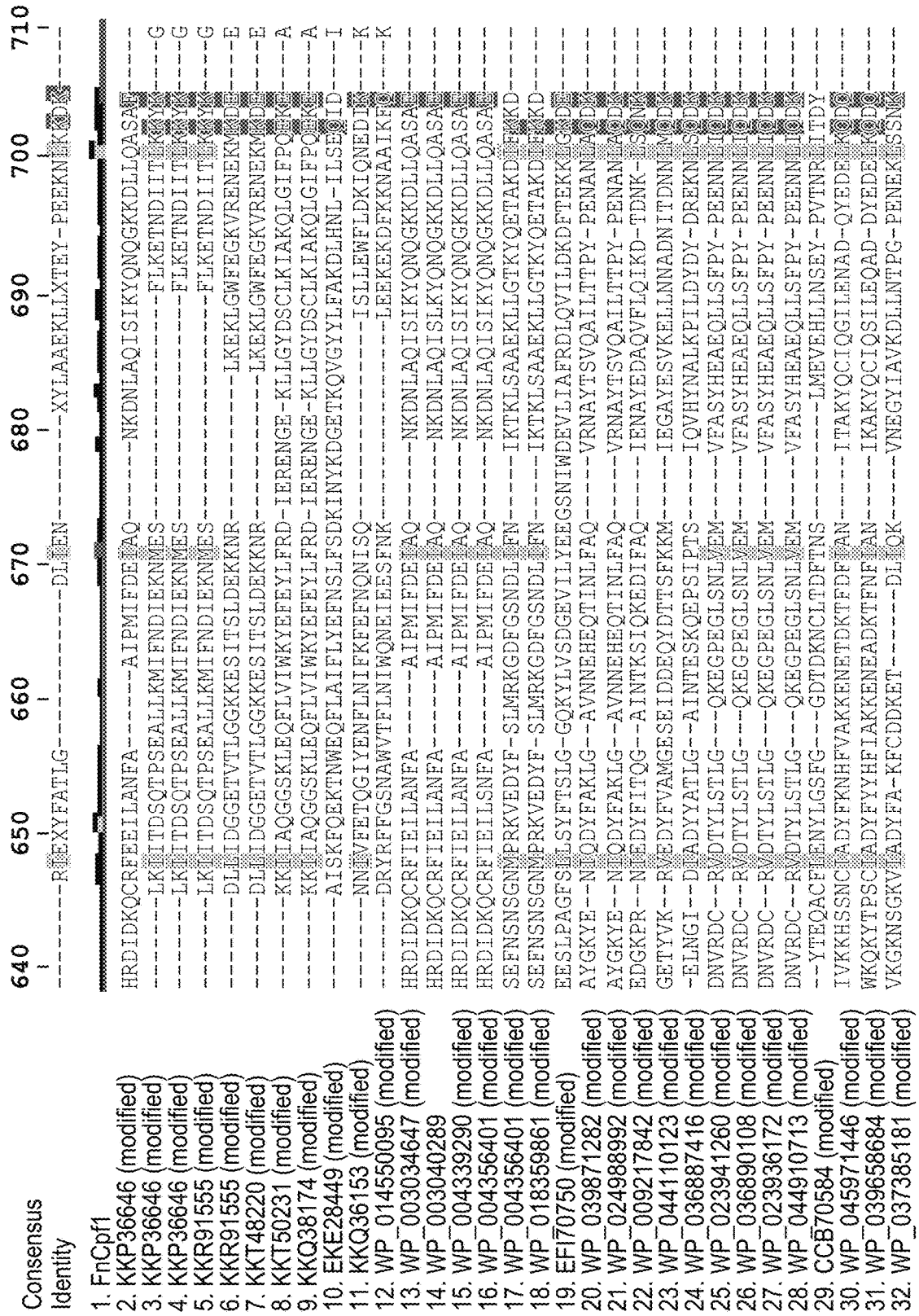
Figure 1L:
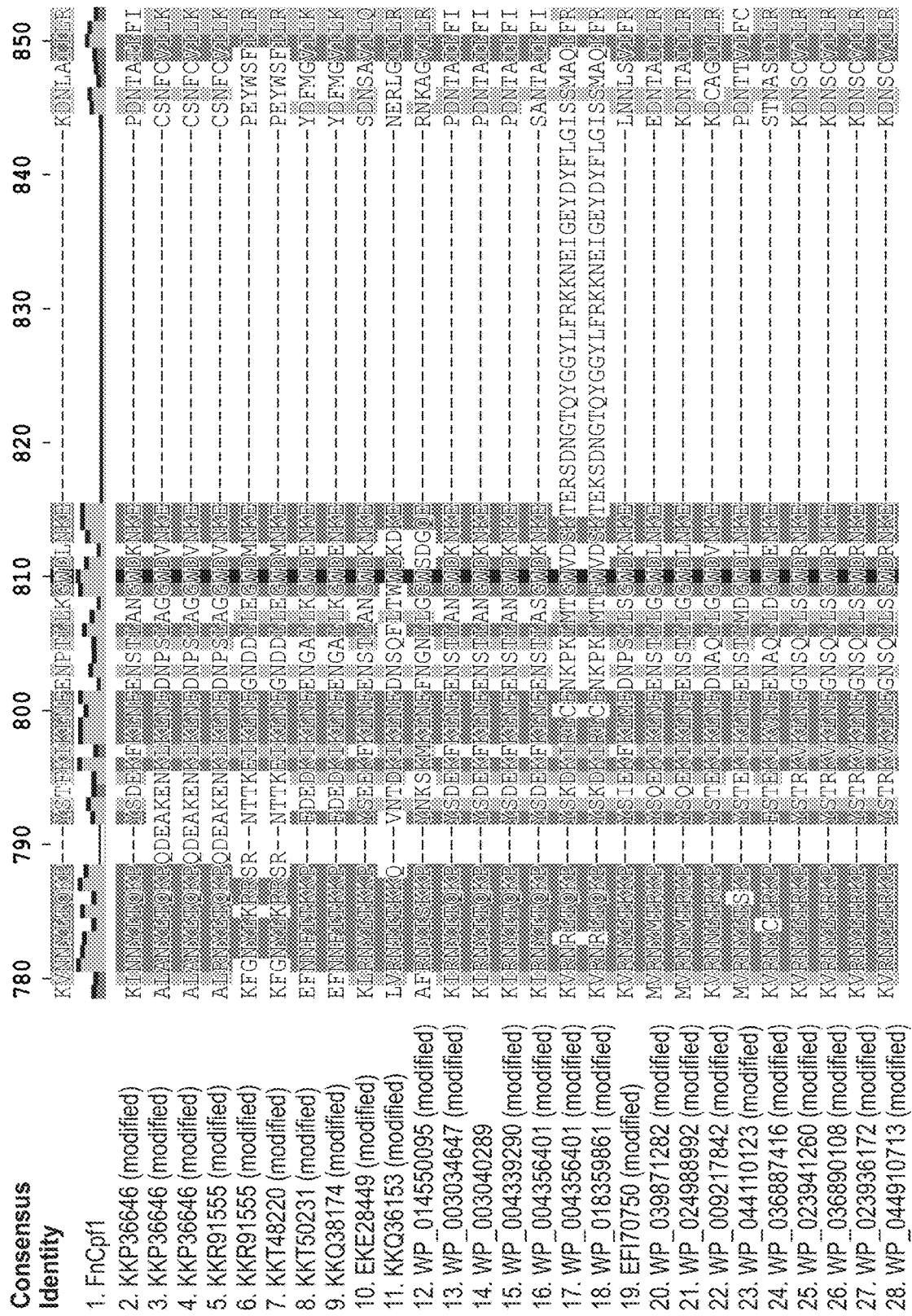
Figure 1V:
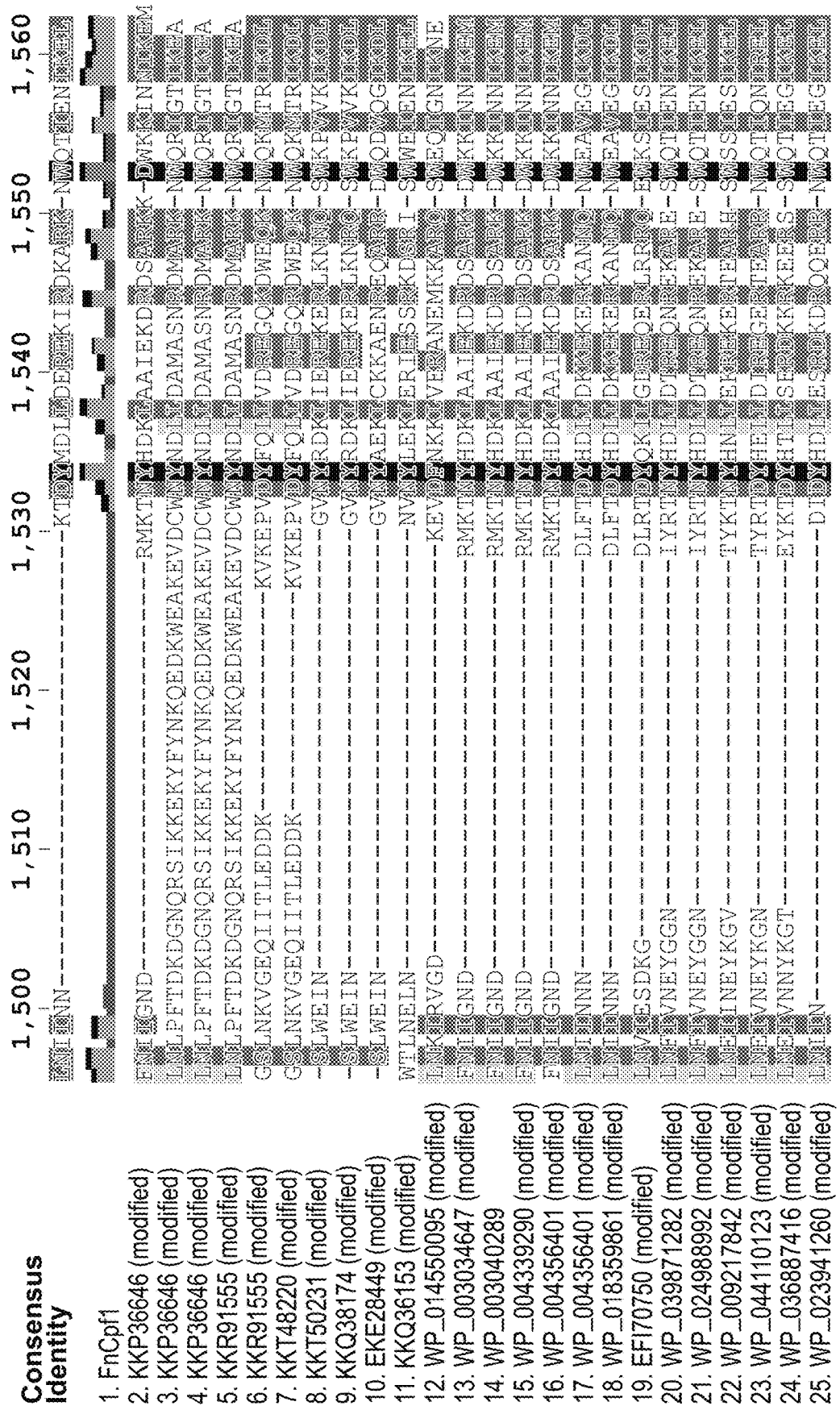
Figure 1W:
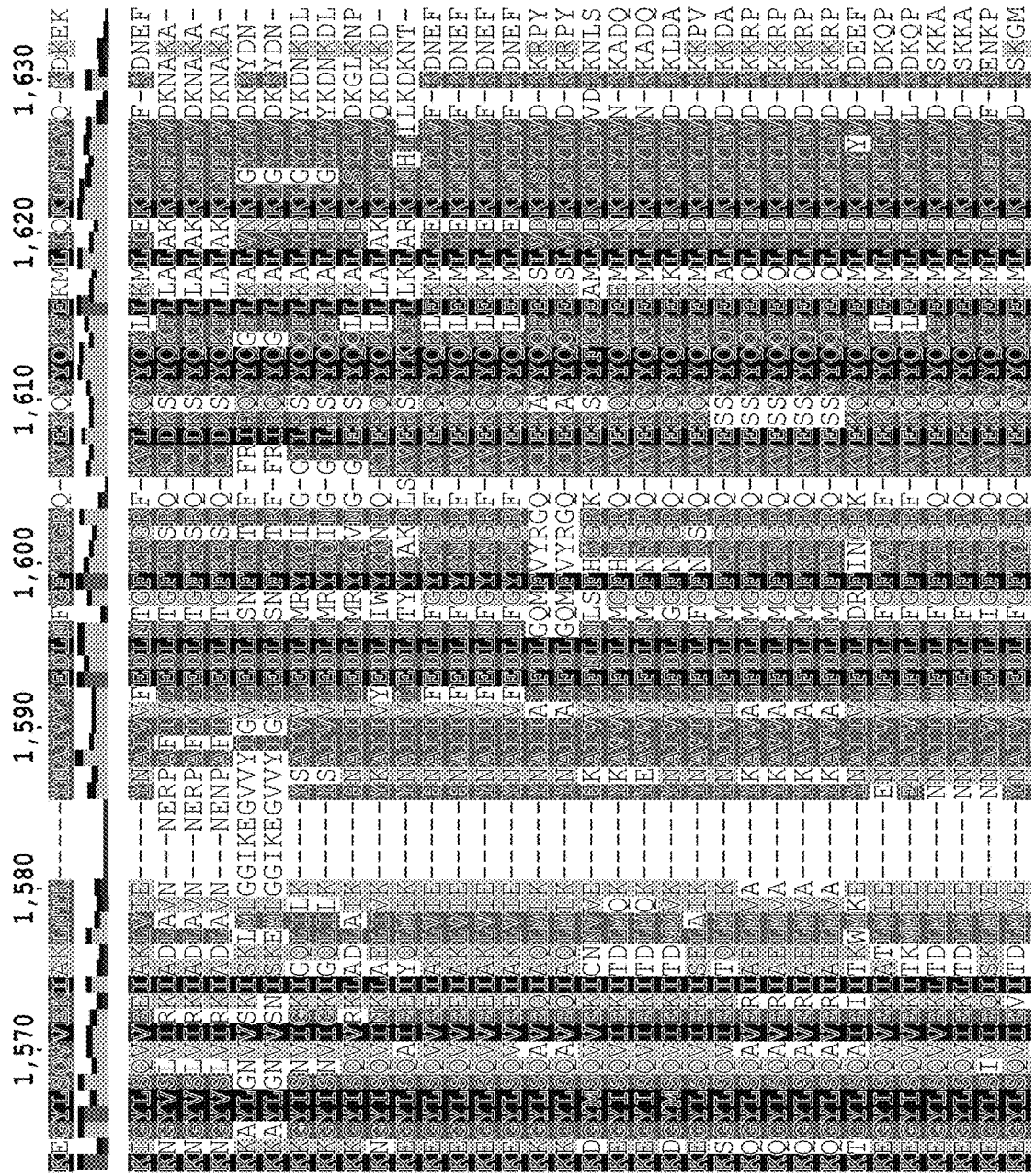
Figure 1W:
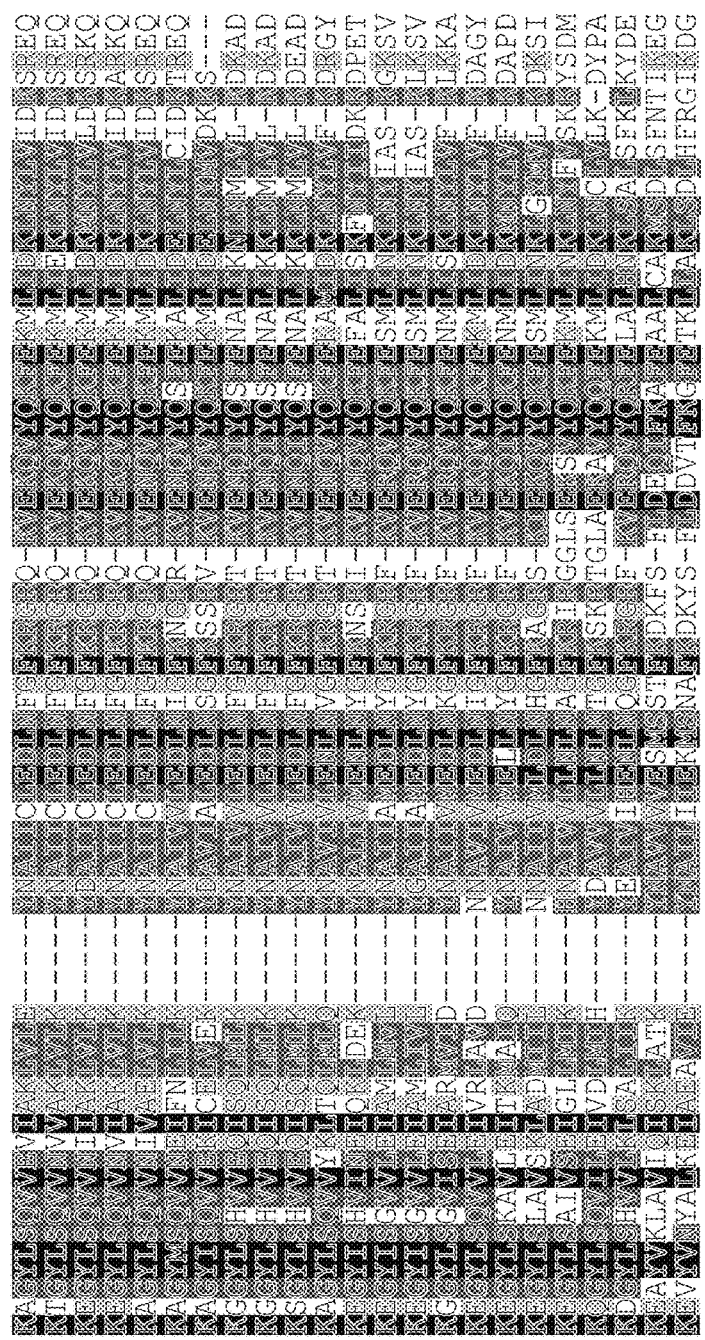
Figure 2A:
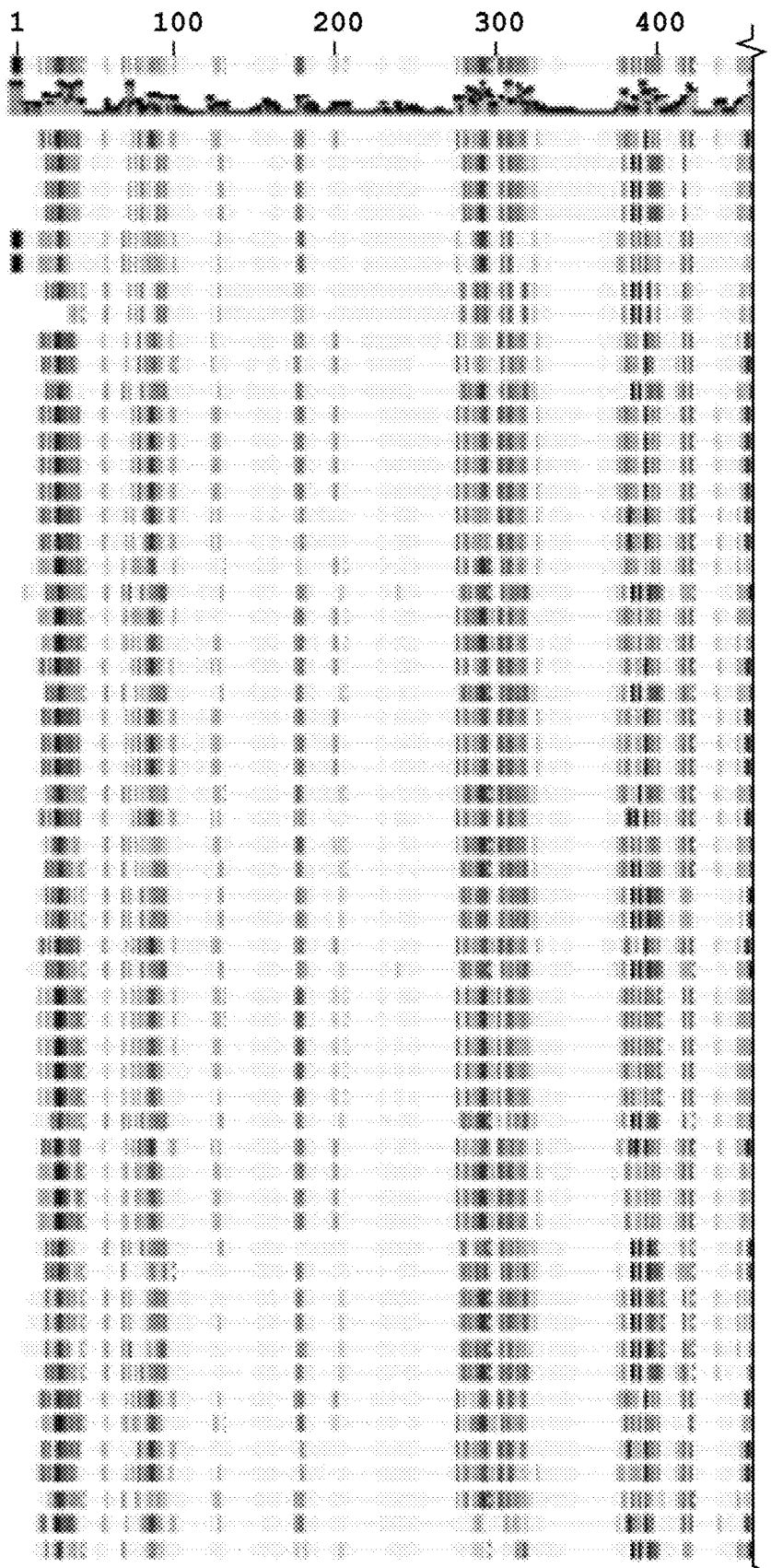
FIGS. 2A-2B show the overview of Cpf1 loci alignment.
Figure 2A:
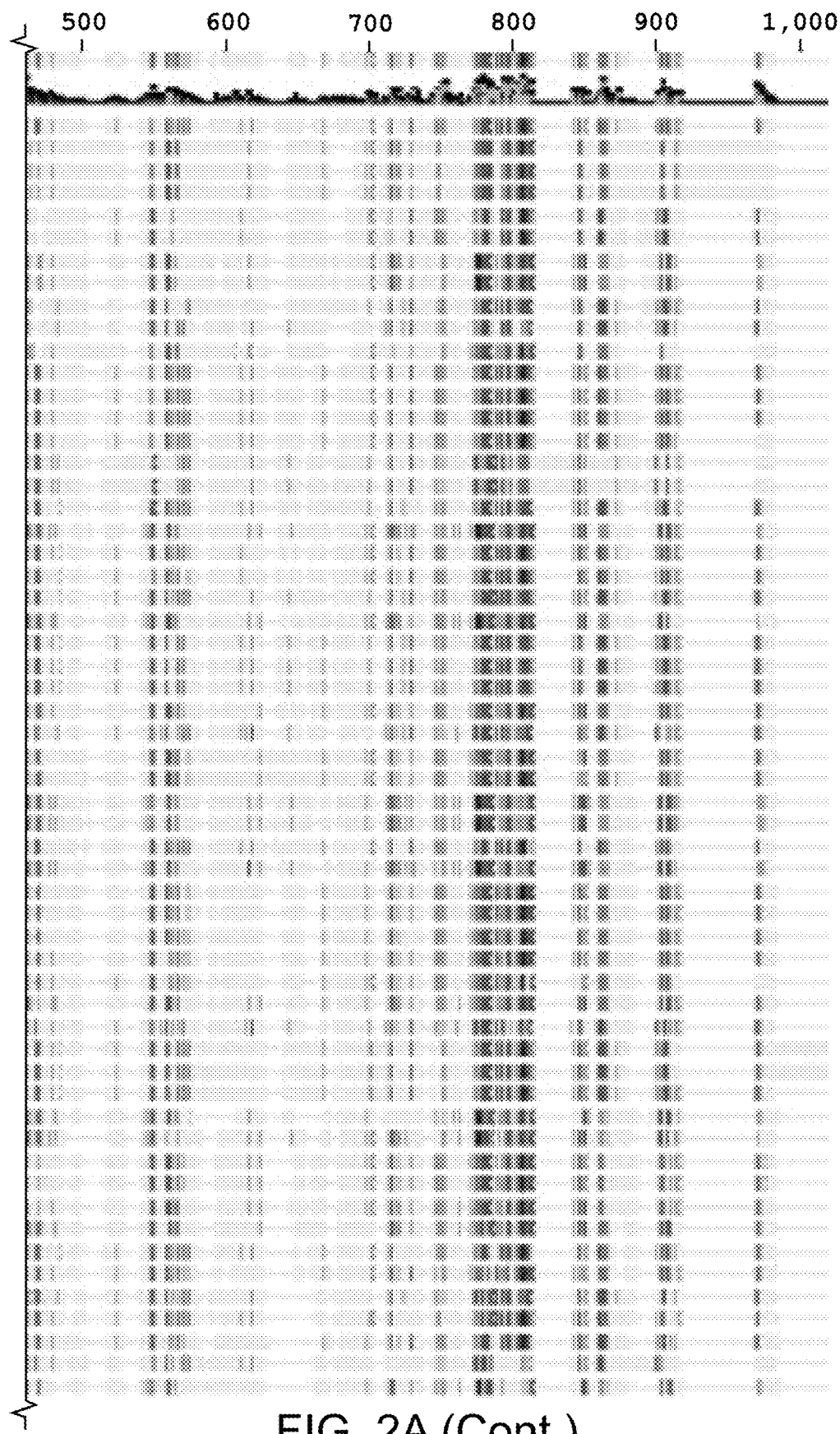
Figure 2B:
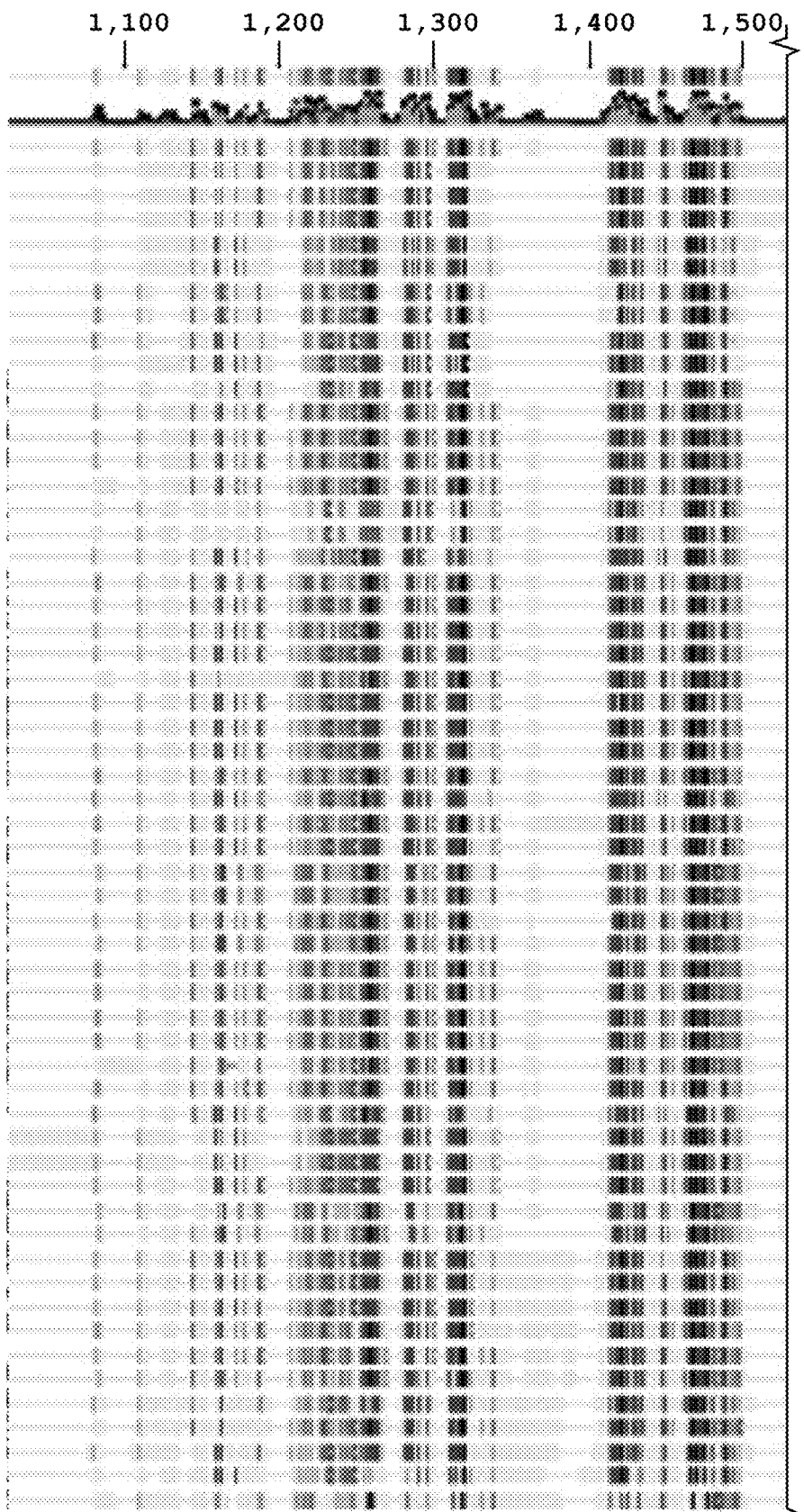
Figure 2B:
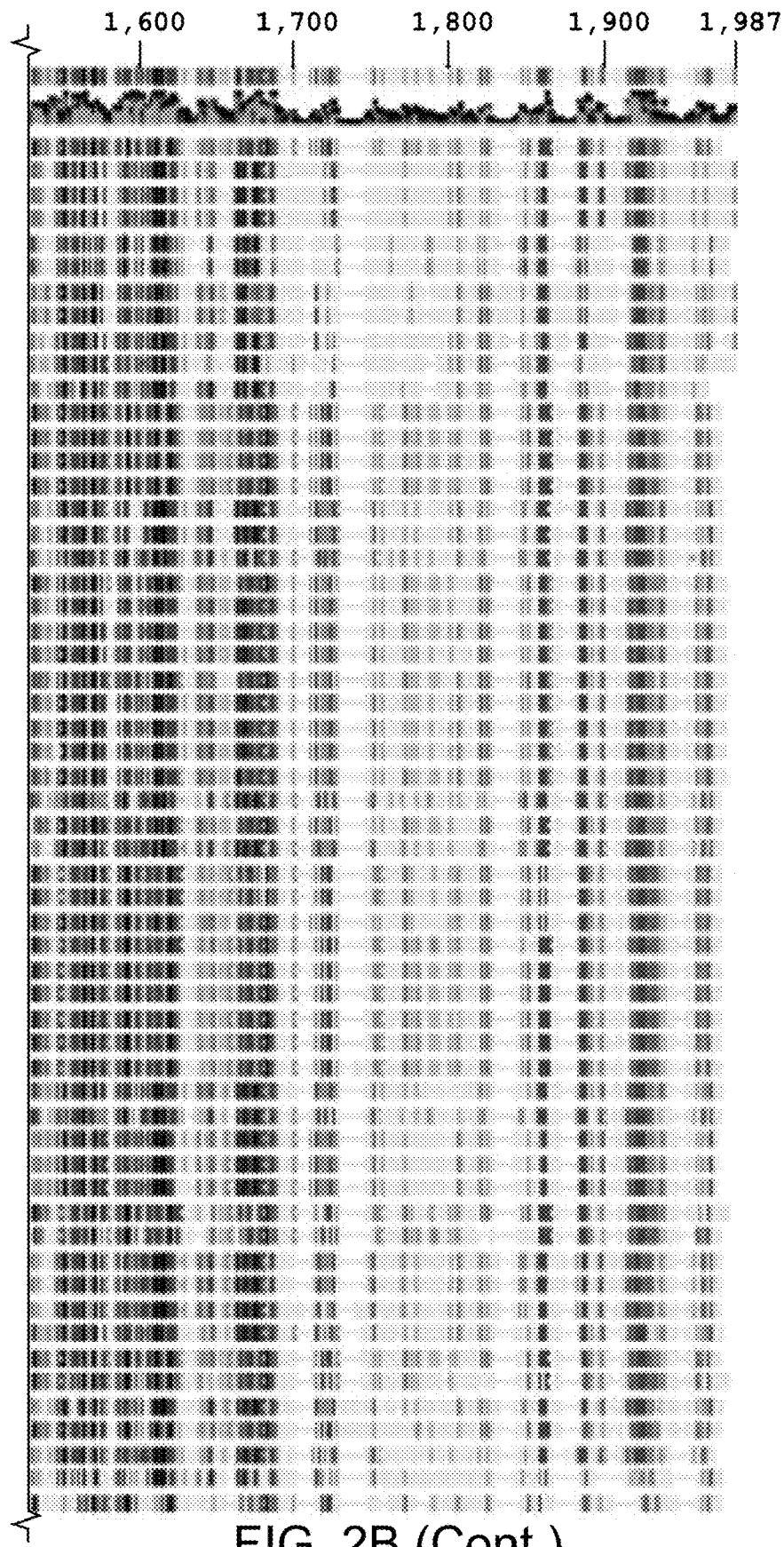
Figure 3V:
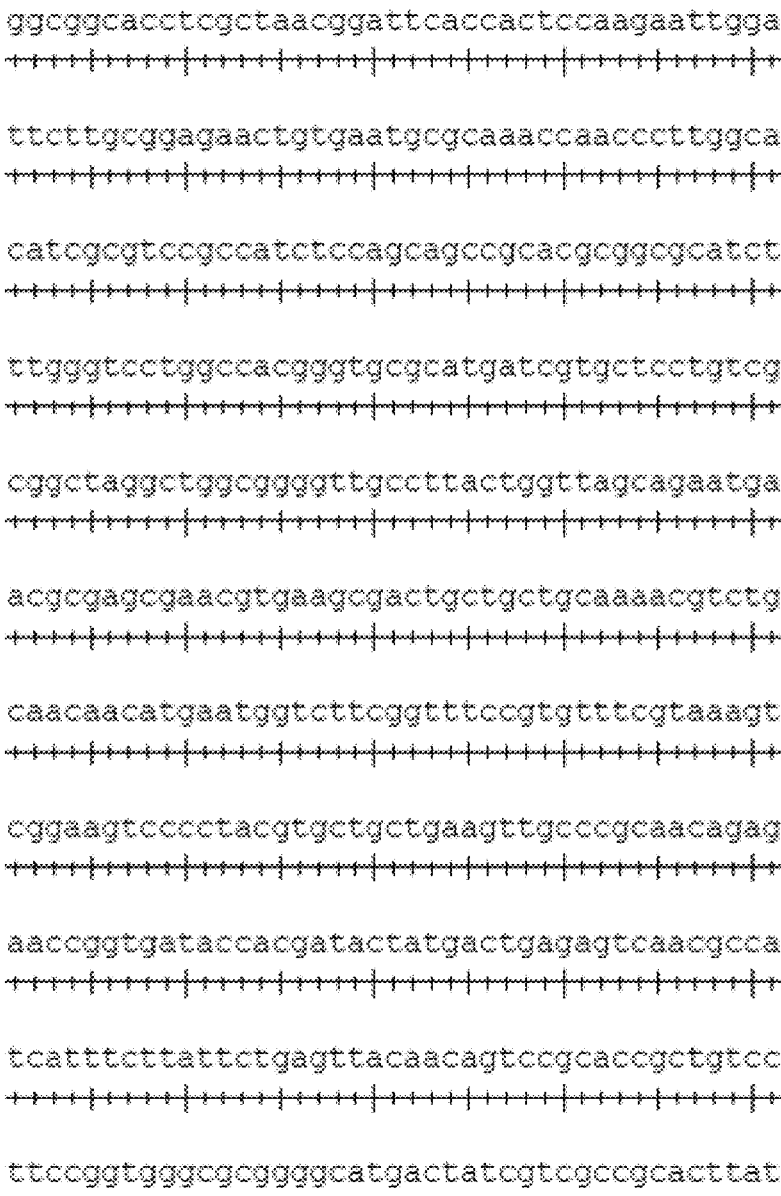
FIGS. 3A-3X shows the PACYC184 FnCpf1 (PY001) vector contruct (SEQ ID NO: 352 and SEQ ID NOS 353-374, respectively, in order of appearance).
Figure 5:
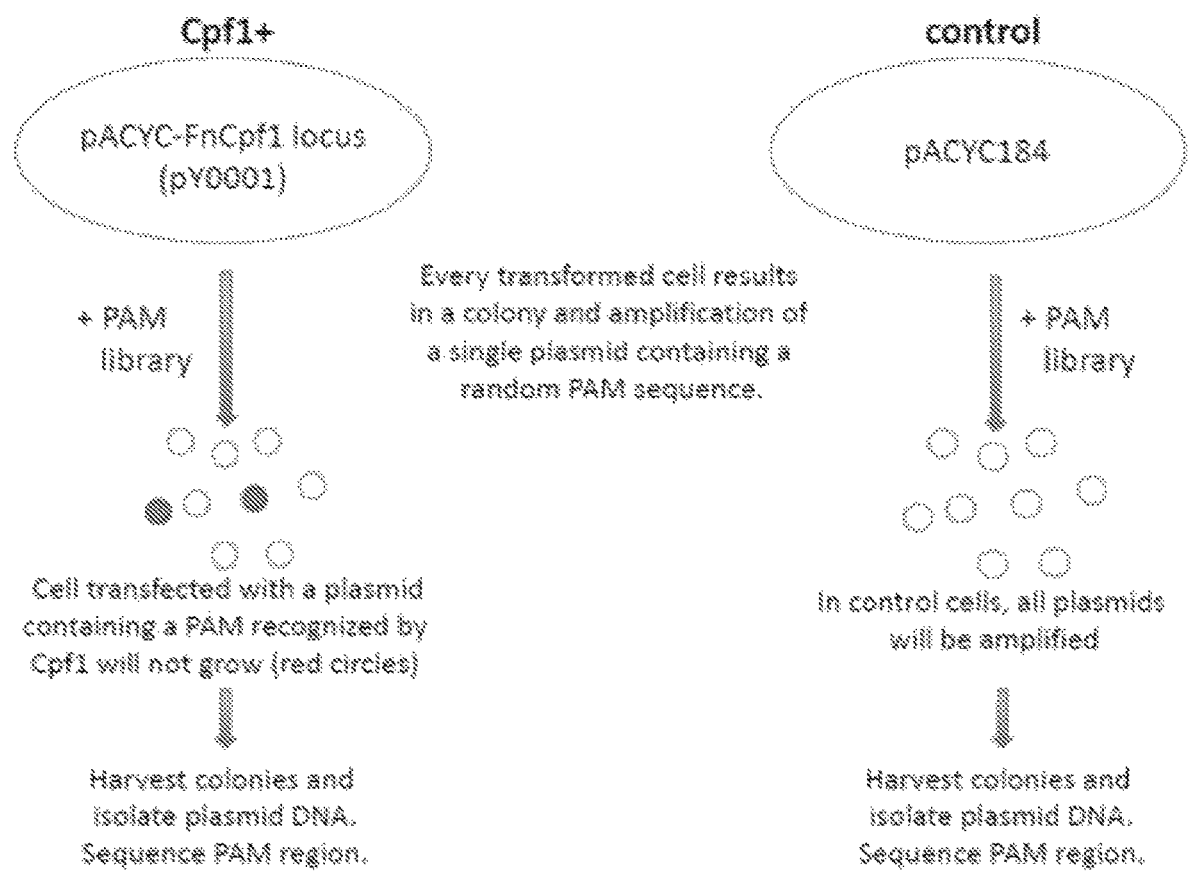
FIG. 5 depicts a PAM challenge assay
Figure 6:
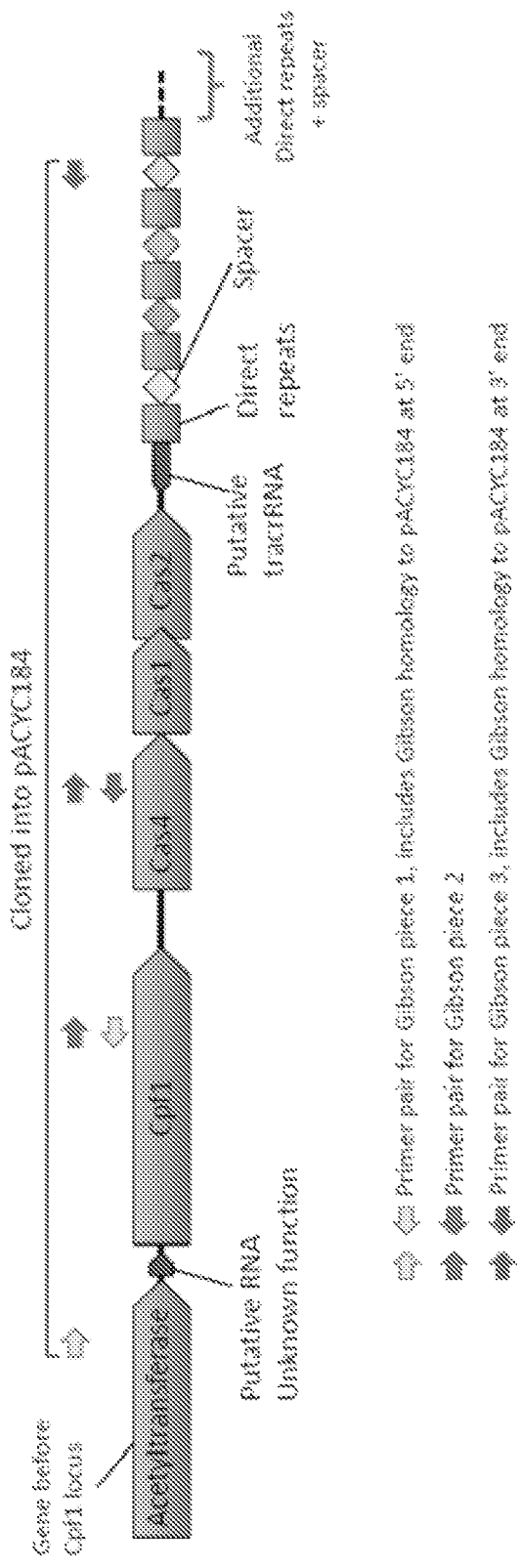
FIG. 6 depicts a schematic of an endogenous FnCpf1 locus. pY0001 is a pACY184 backbone (from NEB) with a partial FnCpf1 locus. The FnCpf1 locus was PCR amplified in three pieces and cloned into Xba1 and Hind3 cut pACYC184 using Gibson assembly. PY0001 contains the endogenous FnCpf1 locus from 255 bp of the acetyltransferase 3' sequence to the fourth spacer sequence. Only spacer 1-3 are potentially active since space 4 is no longer flanked by direct repeats.

PAM Challenge Assay for detection of putative PAM sequences for FnCpf1 (FIG. 5): Applicants isolated the Cpf1 loci from *Francisella novicida* (Fn) (FIG. 6) and transformed it into *E. coli*. The locus was expressed in *E. coli* from pACYC184 similar to the experiment described in Sapranauskas et al.

*E. coli* with pACYC-FnCpf1 locus=Cpf1+
*E. coli* with empty pACYC184=control

Figure 7:
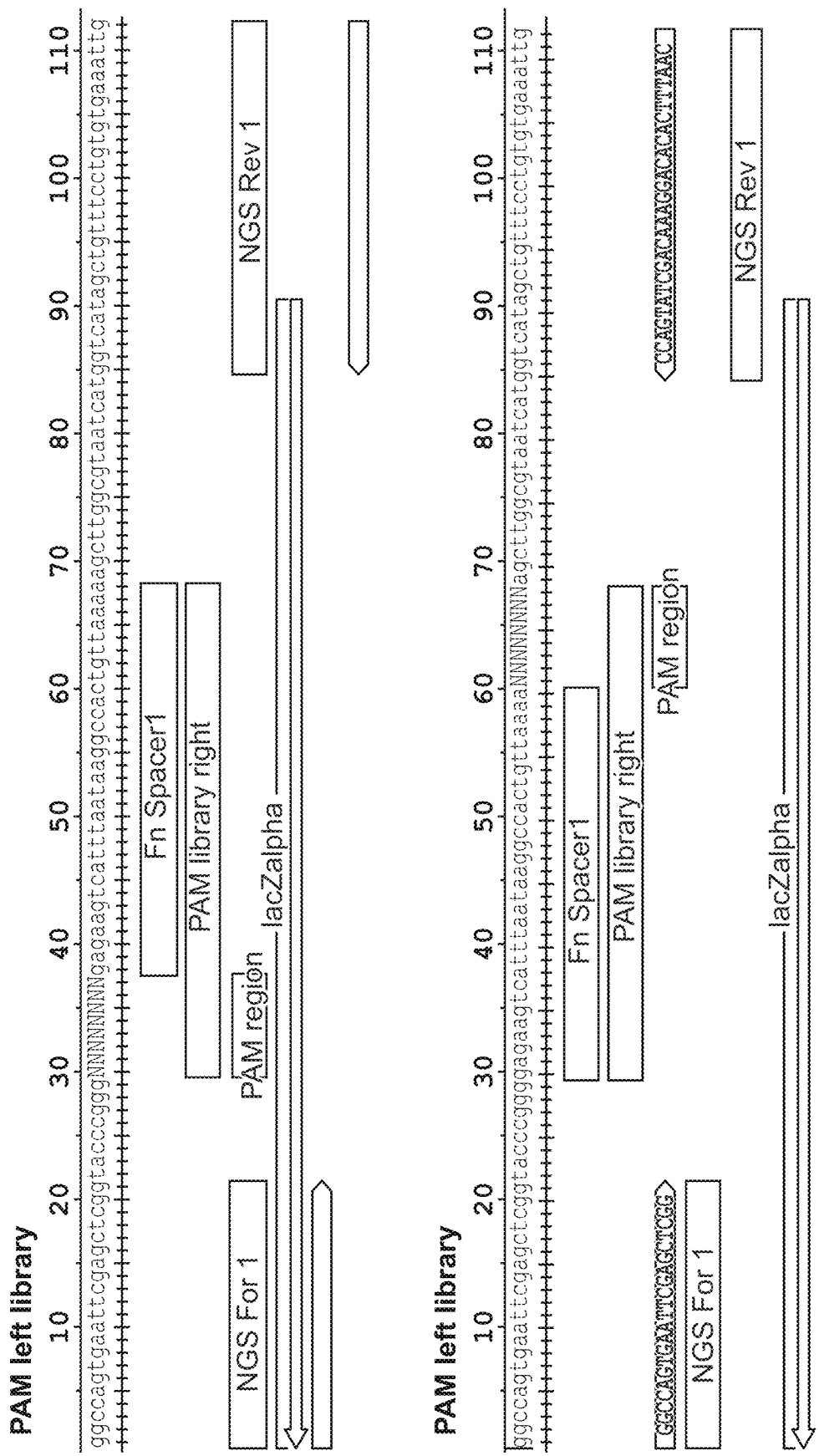
FIG. 7 depicts PAM libraries, which discloses SEQ ID NOS 377-380, respectively, in order of appearance. Both PAM libraries (left and right) are in pUC19. The complexity of left PAM library is 48~65k and the complexity of the right PAM library is 47~16k. Both libraries were prepared with a representation of >500.
Figure 8A:
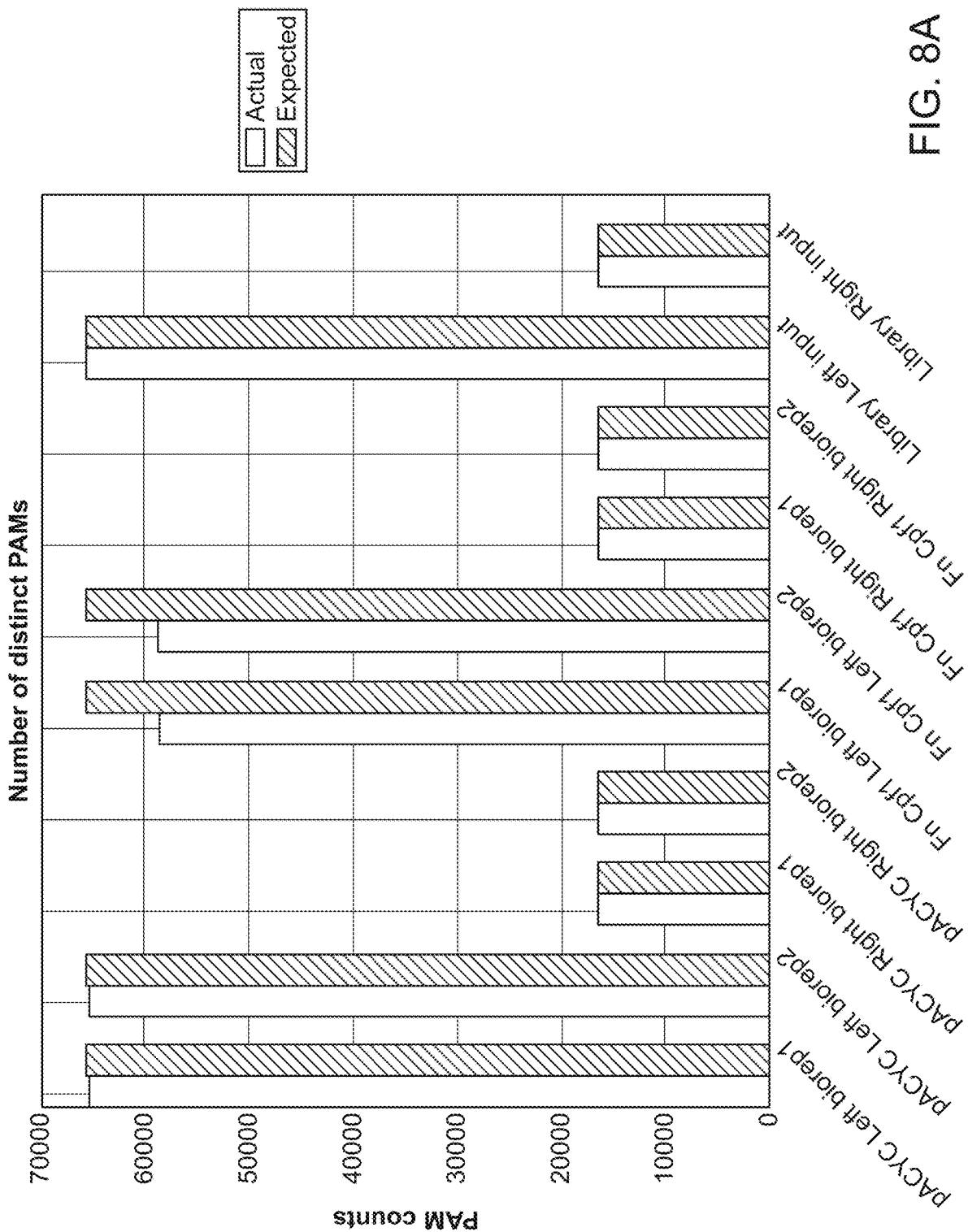
FIG. 8A-8E depicts FnCpf1 PAM Screen Computational Analysis. After sequencing of the screen DNA, the regions corresponding to either the left PAM or the right PAM were extracted. For each sample, the number of PAMs present in the sequenced library were compared to the number of expected PAMs in the library (4^8 for the left library, 4^7 for the right). (A) The left library showed PAM depletion. To quantify this depletion, an enrichment ratio was calculated. For both conditions (control pACYC or FnCpf1 containing pACYC) the ratio was calculated for each PAM in the library as ratio=$-\log_2$ sample+0.01/initial library+0.01. Plotting the distribution shows little enrichment in the control sample and enrichment in both bioreps. (B-D) depict PAM ratio distributions. (E) All PAMs above a ratio of 8 were collected, and the frequency distributions were plotted, revealing a 5' YYN PAM.
Figure 8B:
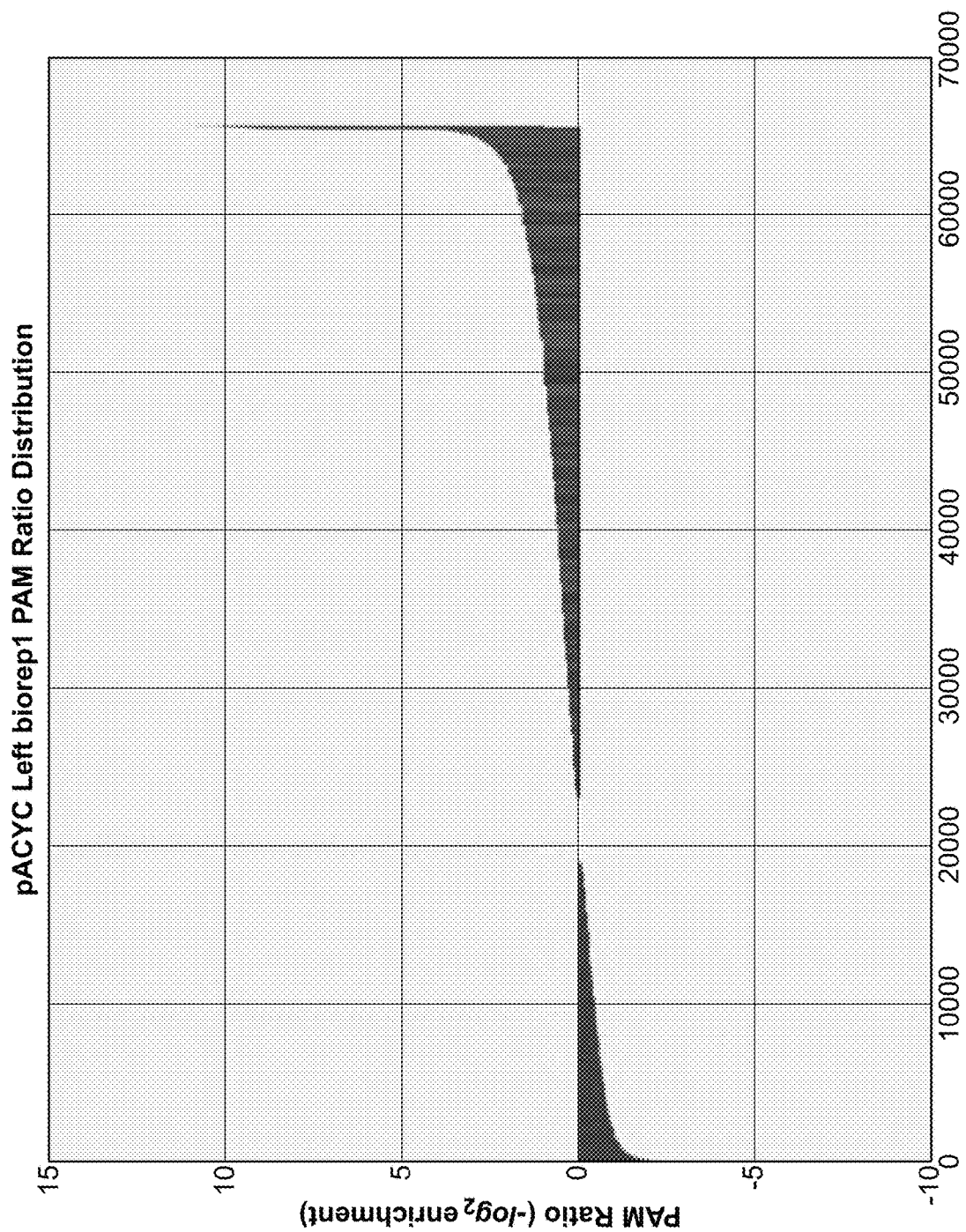
Figure 8C:
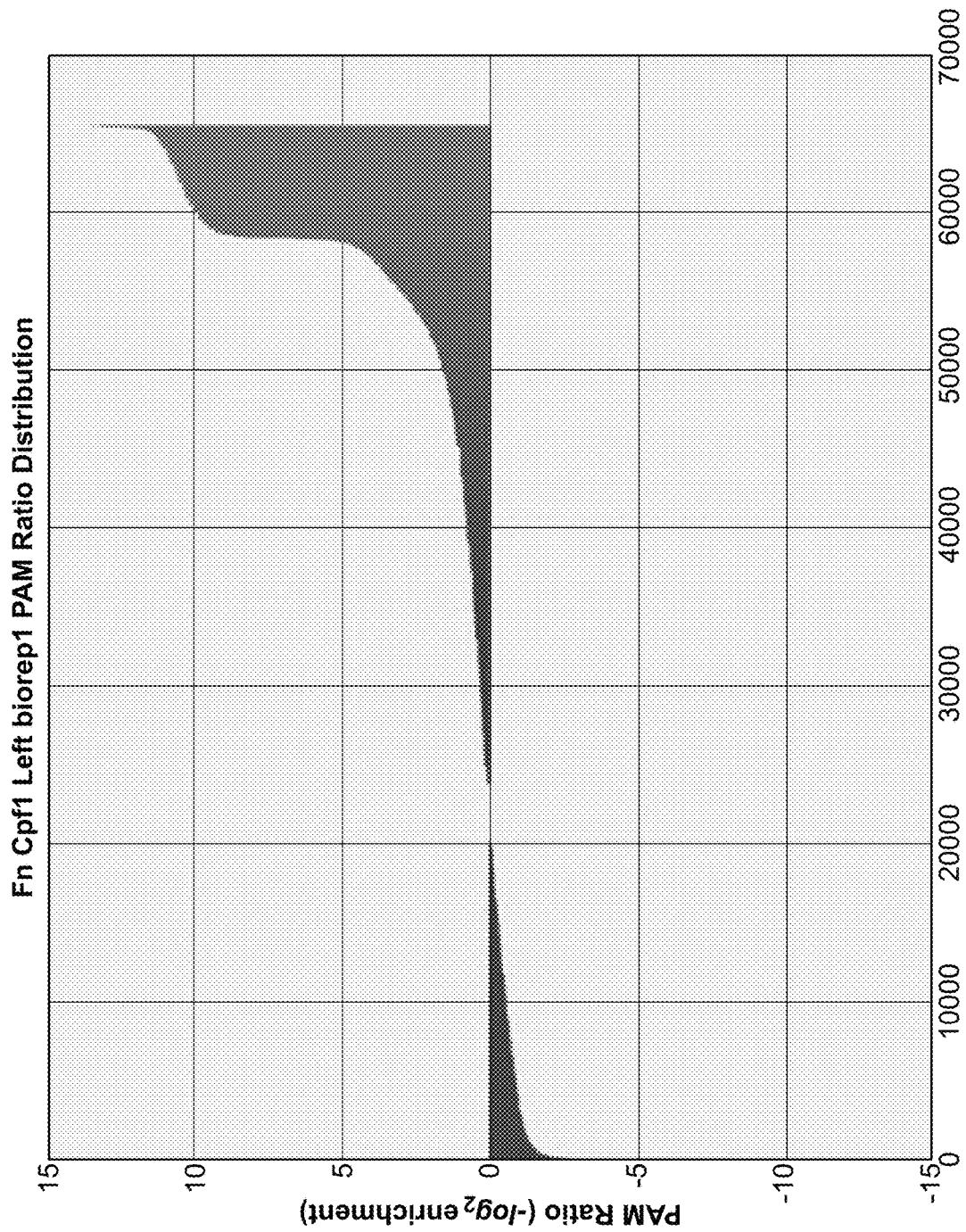
Figure 8D:
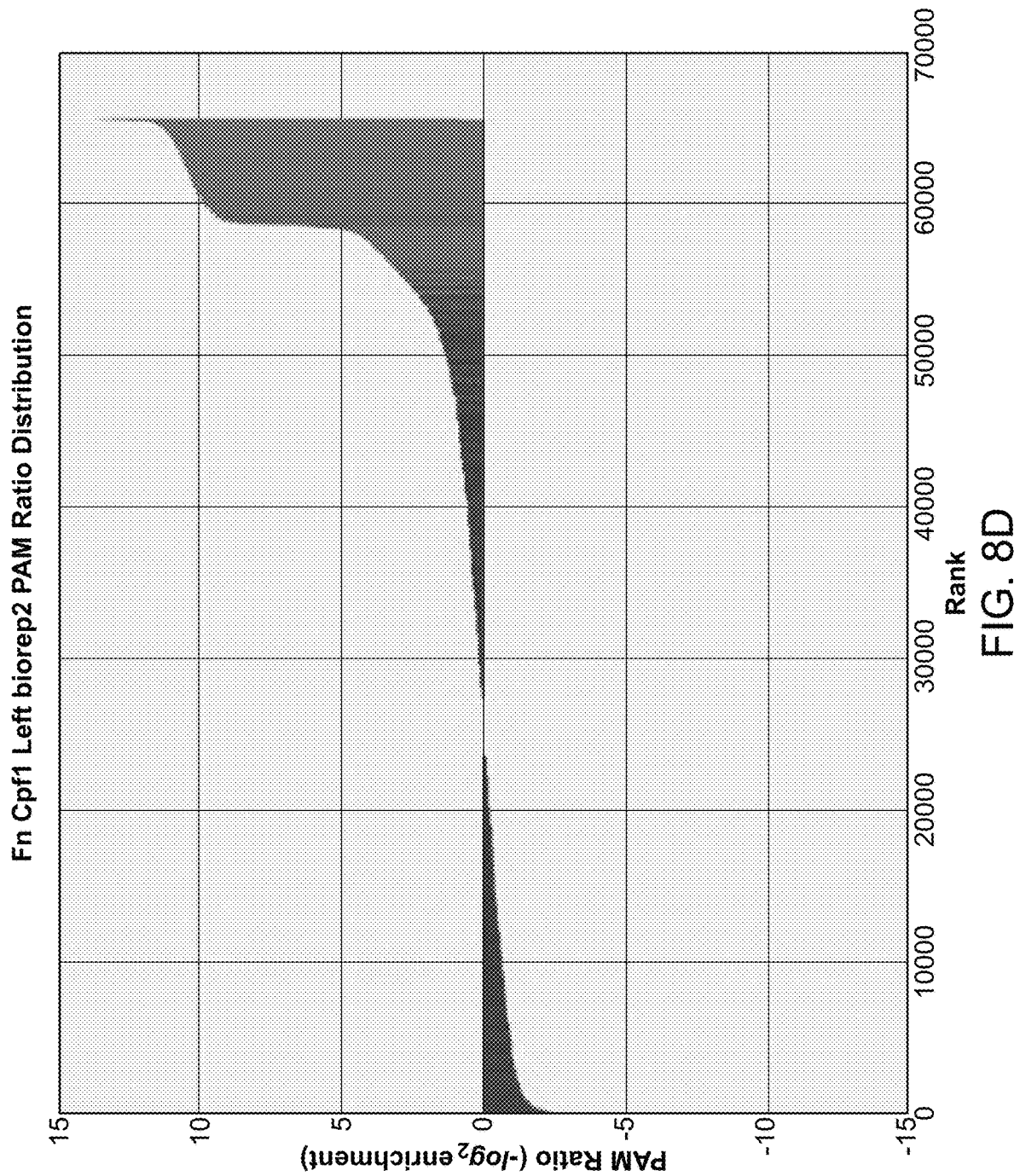
Figure 8E:
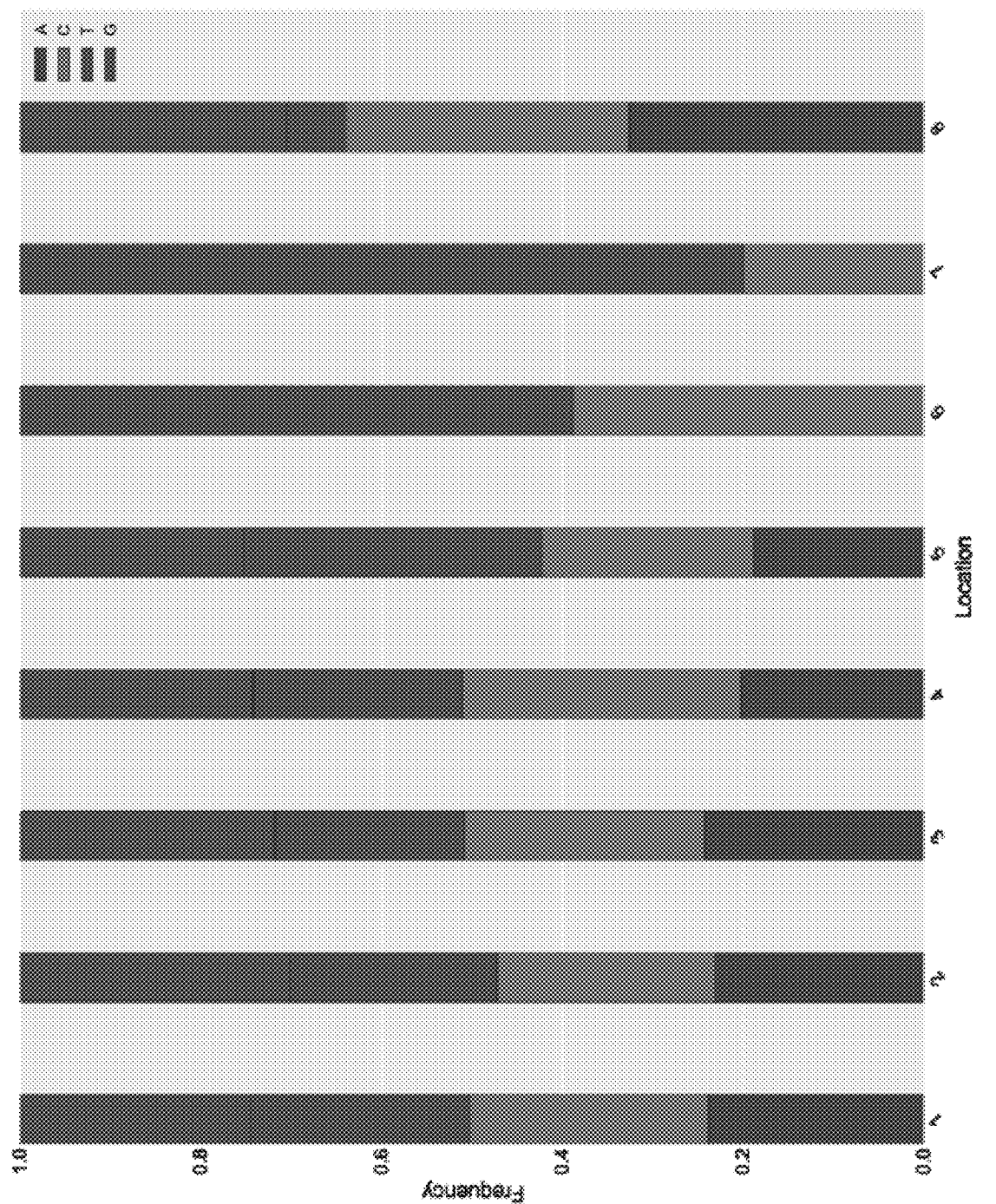

Applicants transformed Cpf1+ and control *E. coli* with PAM library plasmids. Two PAM libraries were obtained (FIG. 7). PAM libraries are pUC19 plasmids containing a 31 bp proto-spacer sequence which matches spacer 1 in FnCpf1 locus. PAM left library had a 8 nt degenerate PAM at the 5' end of the proto-spacer. PAM right library had a 7 nt degenerate PAM at the 3' end of the proto-spacer. Applicants plated Cpf1+ and control *E. coli* and harvested all colonies after ~12h. Each colony represented a PAM-pUC19 transformation event that did not result in cutting/interference by Cpf1. These PAM-pUC19 plasmids do not carry a recognizable PAM. Applicants determined from sequencing of all colonies which PAM-pUC19 plasmids were no longer present compared to control and these plasmids were identified to contain a recognizable PAM.

Cloning of pY0001: pY0001 is a pACYC184 backbone (from NEB) with a partial FnCpf1 locus. pY0001 contains the endogenous FnCpf1 locus from 255 bp of the acetyltransferase 3' sequence to the 4th spacer sequence. Only spacer 1-3 are potentially active since spacer 4 is not longer flanked by direct repeats.

Applicants PCR amplified the FnCpf1 locus in 3 pieces and cloned into Xba1 & Hind3 cut pACYC184 using Gibson assembly.

Cpf1 PAM Screen Computational Analysis

After sequencing of the screen DNA, Applicants extracted the regions corresponding to either the left PAM or the right PAM. For each sample, the number of PAMs present in the sequenced library were compared to the number of expected PAMs in the library (4^8 for the left library, 4^7 for the right).

The left library showed PAM depletion. To quantify this depletion, Applicants calculated an enrichment ratio. For both conditions (control pACYC or FnCpf1 containing pACYC), Applicants calculated the ratio for each PAM in the library as:

$$\text{ratio} = -\log_2 \frac{\text{sample} + 0.01}{\text{initial library} + 0.01}$$

Applicants determined that plotting the distribution showed little enrichment in the control sample and enrichment in both bioreps. Applicants collected all PAMs above a ratio of 8, and plotted the frequency distributions, revealing a 5' YYN PAM (FIGS. 8A-E). Applicants confirmed that the PAM is TTN, where N is A/C/G or T.

Figure 9:
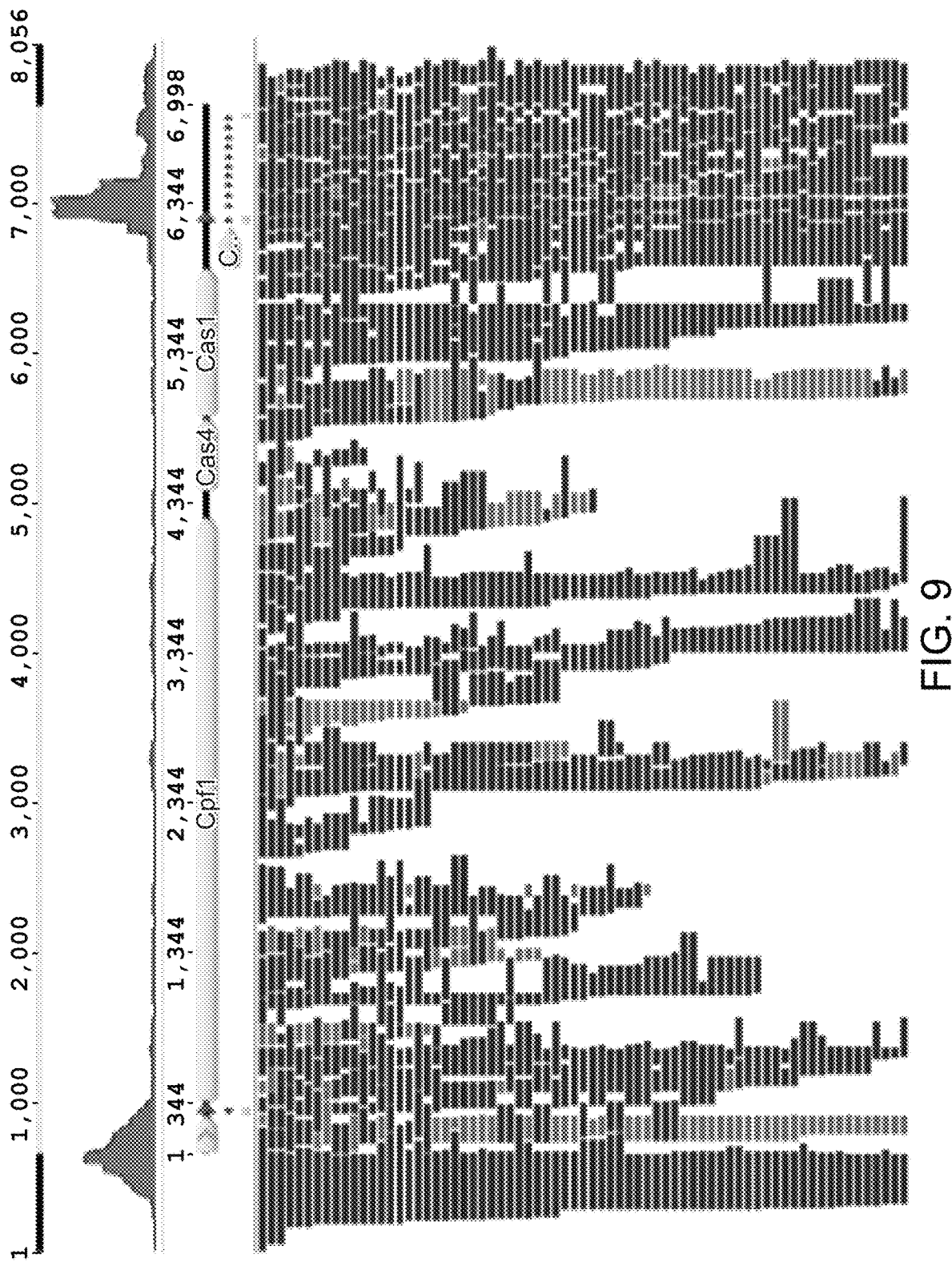
FIG. 9 depicts RNAseq analysis of the *Francisella* tolerances Cpf1 locus, which shows that the CRISPR locus is actively expressed. In addition to the Cpf1 and Cas genes, two small non-coding transcript are highly transcribed, which might be the putative tracrRNAs. The CRISPR array is also expressed. Both the putative tracrRNAs and CRISPR array are transcribed in the same direction as the Cpf1 and Cas genes. Here all RNA transcripts identified through the RNAseq experiment are mapped against the locus. After further evaluation of the FnCpf1 locus, Applicants concluded that target DNA cleavage by a Cpf1 effector protein complex does not require a tracrRNA. Applicants determined that Cpf1 effector protein complexes comprising only a Cpf1 effector protein and a crRNA (guide RNA comprising a direct repeat sequence and a guide sequence) were sufficient to cleave target DNA.
Figure 10:
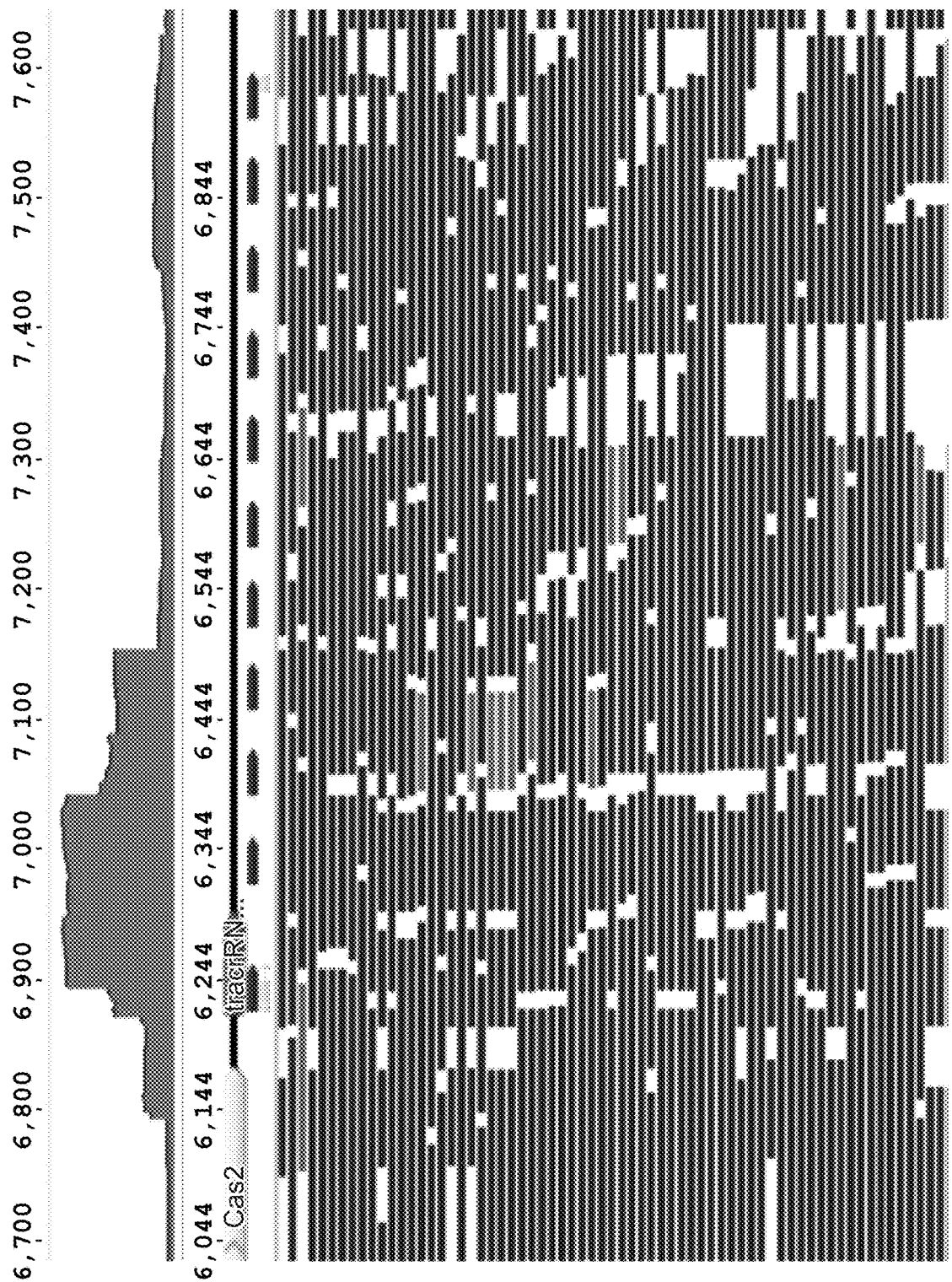
FIG. 10 depicts zooming into the Cpf1 CRISPR array. Many different short transcripts can be identified. In this plot, all identified RNA transcripts are mapped against the Cpf1 locus.
Figure 11:
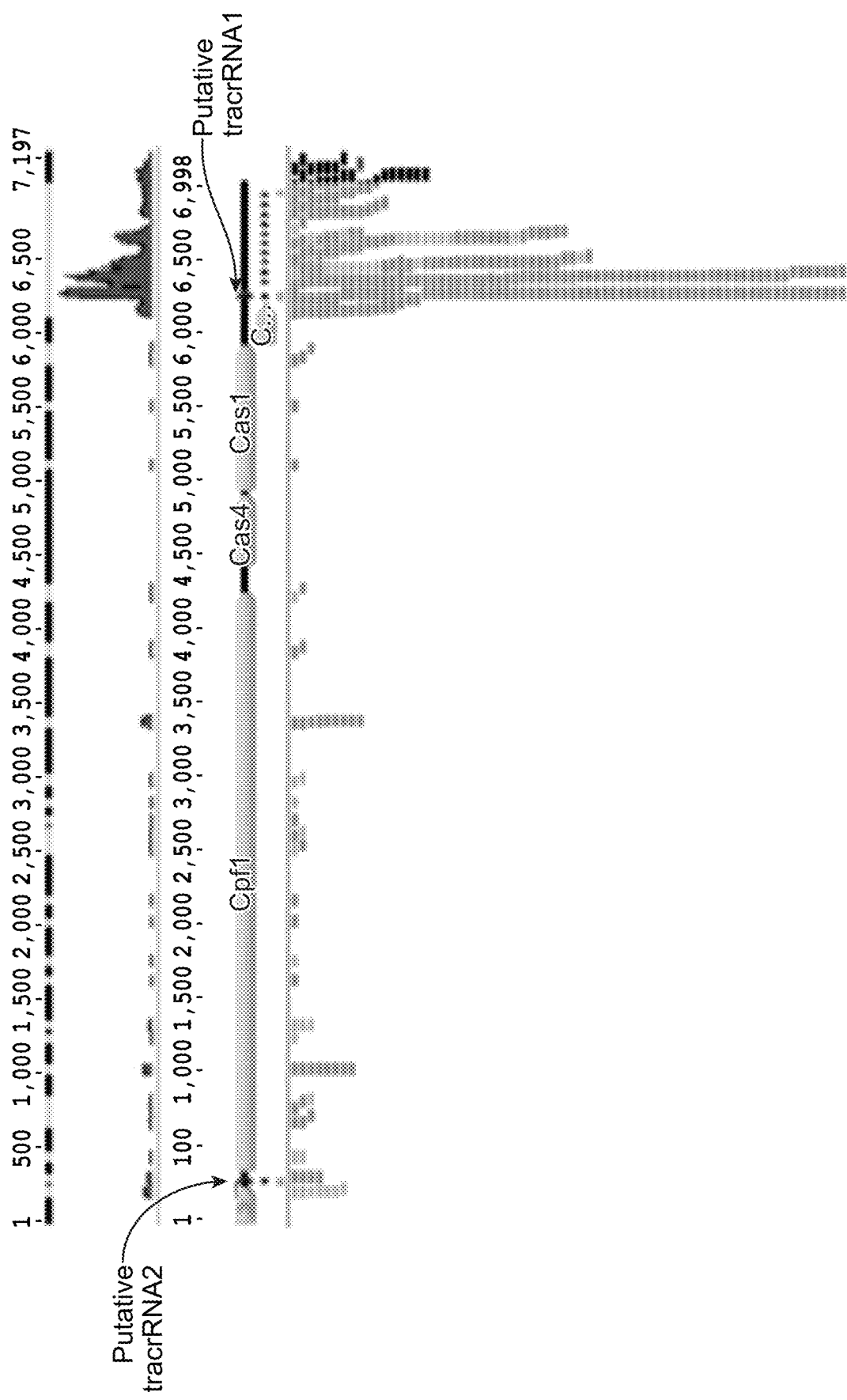
FIG. 11 depicts identifying two putative tracrRNAs after selecting transcripts that are less than 85 nucleotides long
Figure 12:
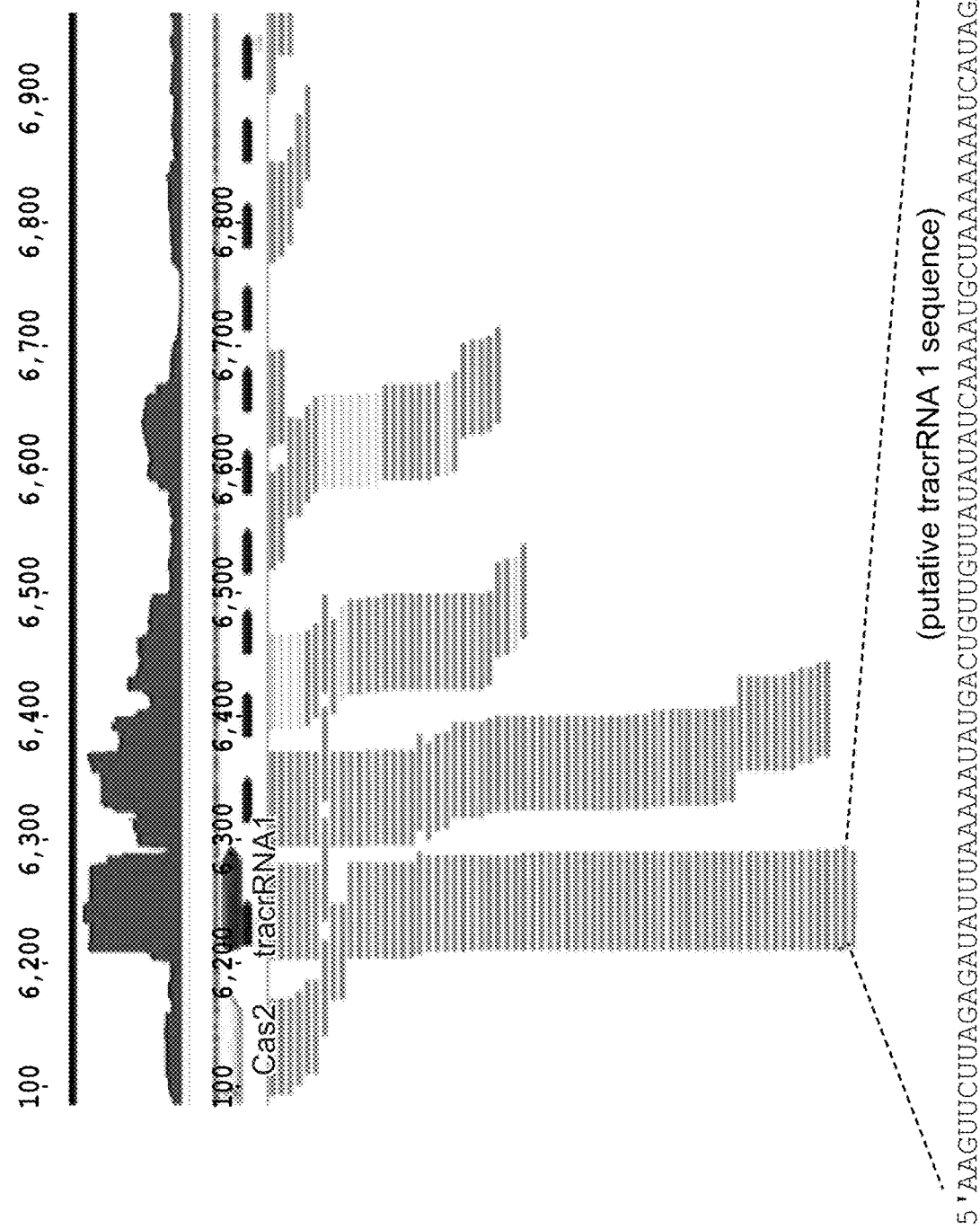
FIG. 12 depicts zooming into putative tracrRNA 1 (SEQ ID NO: 381) and the CRISPR array
Figure 13:
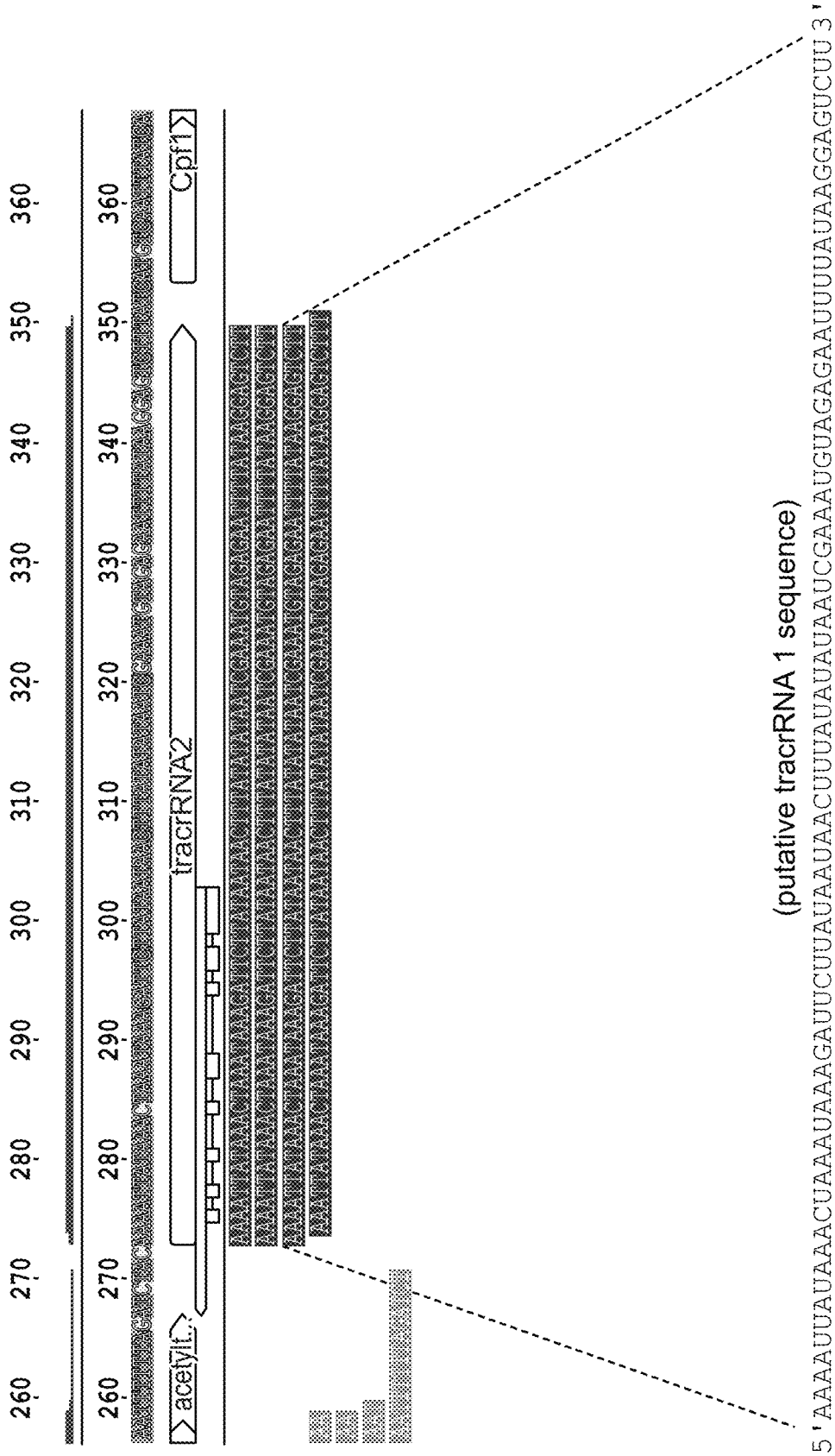
FIG. 13 depicts zooming into putative tracrRNA 2 which discloses SEQ ID NOS 382-388, respectively, in order of appearance.
Figure 14:
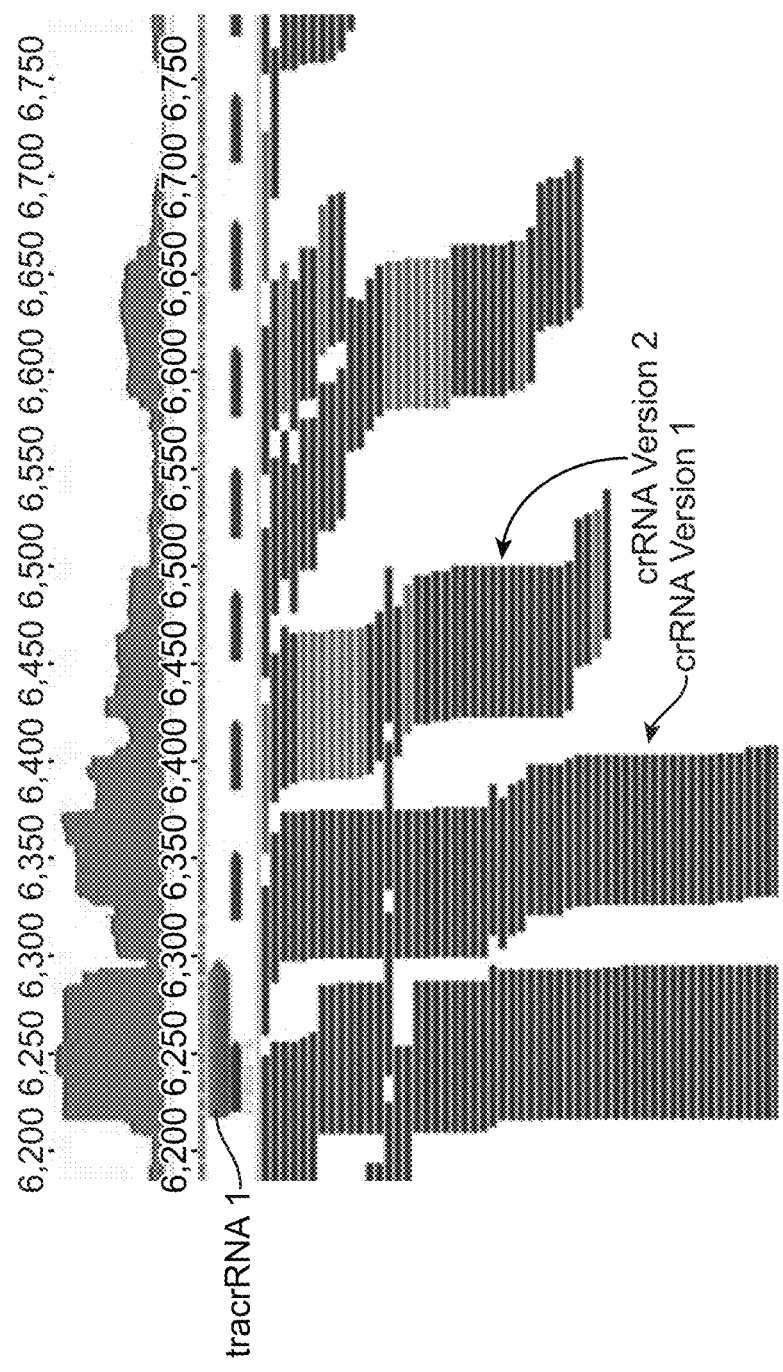
FIG. 14 depicts putative crRNA sequences (repeat in blue, spacer in black) (SEQ ID NOS 389 and 390, respectively, in order of appearance).

Applicants performed RNA-sequencing on *Francisella tolerances* Cpf1 locus and the RNAseq analysis showed that the CRISPR locus was actively expressed (FIG. 9). A further depiction of the RNAseq analysis of the FnCpf1 locus is shown in FIG. 49. In addition to the Cpf1 and Cas genes, two small non-coding transcripts were highly transcribed, which Applicants surmised were putative tracrRNAs. The CRISPR array is also expressed. Both the putative tracrRNAs and CRISPR array are transcribed in the same direction as the Cpf1 and Cas genes. Here all RNA transcripts identified through the RNAseq experiment are mapped against the locus. Zooming into the Cpf1 CRISPR array Applicants identified many different short transcripts. In this plot, all identified RNA transcripts are mapped against the Cpf1 locus (FIG. 10). After selecting transcripts that are less than 85 nucleotides long, Applicants identified two putative tracrRNAs (FIG. 11). FIG. 12 shows a zoomed in perspective of putative tracrRNA 1 and the CRISPR array. FIG. 13 shows a zoomed in perspective of putative tracrRNA 2. Putative crRNA sequences are indicated in FIG. 14.

Applicants test for function in mammalian cells using U6 PCR products: spacer (DR-spacer-DR) (in certain aspects spacers may be referred to as crRNA or guide RNA or an analogous term as described in this application) and tracr for other identified Cpf1 loci.

Example 4: Further Validation Experiments for FnCpf1

Figure 15:
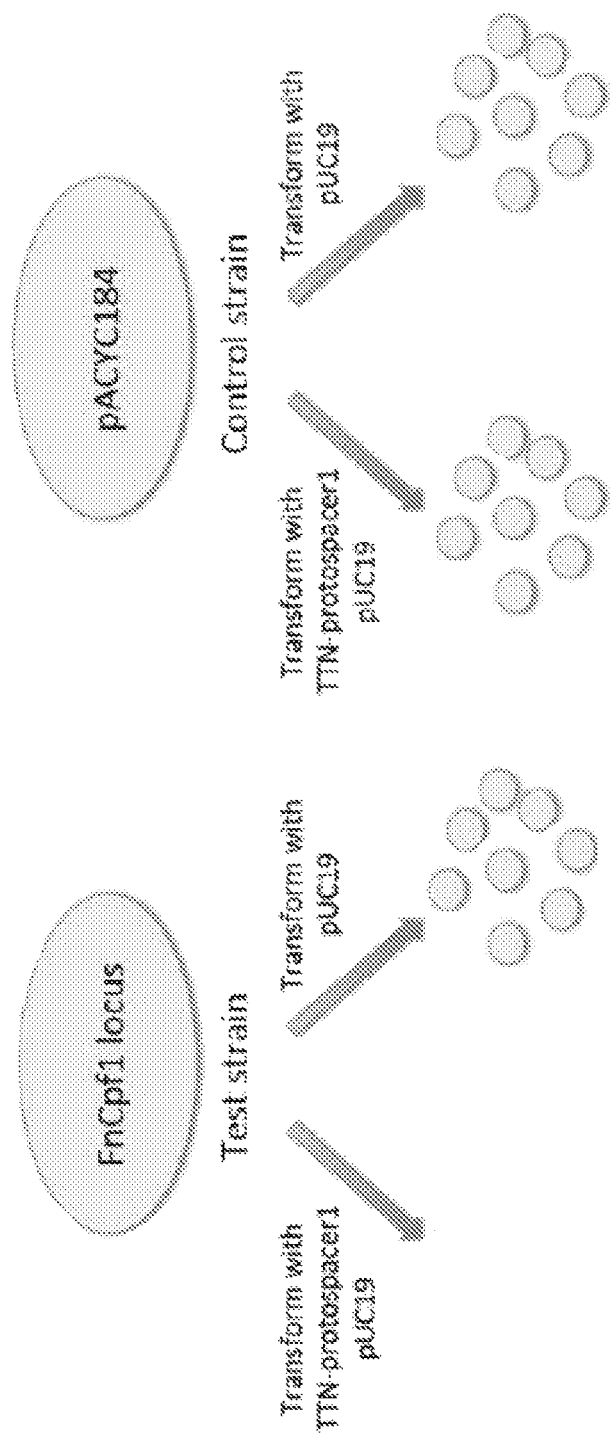
FIG. 15 shows a schematic of the assay to confirm the predicted FnCpf1 PAM in vivo.
Figure 16:
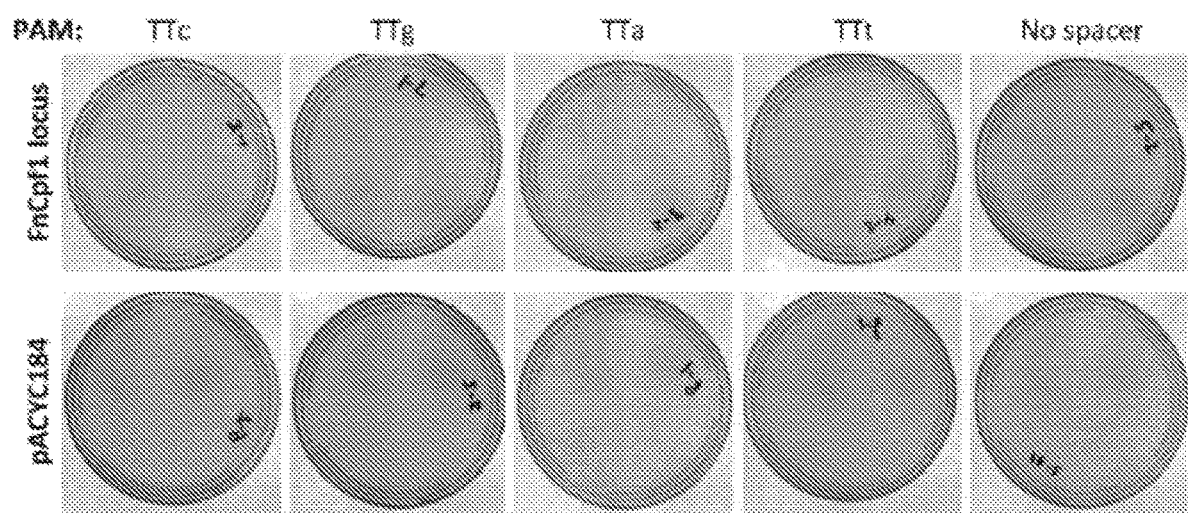
FIG. 16 shows FnCpf1 locus carrying cells and control cells transformed with pUC19 encoding endogenous spacer 1 with 5' TTN PAM.

Applicants confirmed the predicted FnCpf1 PAM is TTN in vivo by using the assay outlined in FIG. 15. Applicants transformed FnCpf1 locus carrying cells and control cells with pUC19 encoding endogenous spacer 1 with 5' TTN PAM (FIG. 16). Briefly, in the in vivo PAM confirmation assay, 50 µl of competent *E. coli* with FnCpf1 locus (test strain) or with empty pACYC184 (control strain) were transformed with 10 ng proto-spacer 1 carrying plasmids. Preceding the proto-spacer sequence are predicted PAM sequences (TTC, TTG, TTA and TTT). After transformation cells were diluted 1:2000 and plated on LB agar plates containing ampicillin and chloramphenicol. Only cells with intact proto-spacer plasmid can form colonies. Plates with colonies were imaged ~14h after plating and colonies were counted using the ImageJ software.

Applicants performed Cell Lysate Cleavage Assays to further validate FnCpf1 cleavage. The protocol for the cell lysate cleavage assay is as follows:

In vitro cleavage reaction. Cleavage buffer: 100 mM HEPES pH 7.5, 500 mM KCl, 25 mM MgCl2, 5 mM DTT, 25% glycerol. The stock may be made without DTT.

Making Cell Lysate

Lysis buffer: 20 mM Hepes pH 7.5, 100 mM potassium chloride [KCl], 5 mM magnesium chloride [MgCl2], 1 mM dithiothreitol [DTT], 5% glycerol, 0.1% Triton X-100, supplemented with 10× Roche Protease Inhibitor cocktail. Concentrated stock of lysis buffer w/o Roche Protease Inhibitor and DTT may be maintained. Keep at −20° C.

Transfect HEK cells with recommended amount of DNA with Lipofectamine 2000
- 500 ng per 24 well
- 2000 ng per 6 well Harvest cells with lysis buffer 24-72 hours post transfection
- Aspirate off media
- Wash gently with DPBS
- Aspirate off DPBS
- Use 50 ul of lysis buffer per 24 well or 250 ul per 6 well
- Let sit on ice for 5 min
- Transfer into Eppendorf tube
- Ice for 15 minutes
- Sonicate at high power, 50% duty cycle for 5-10 min
- Spin down cold at max speed for 20 min
- Transfer supernatant to new tube
- Aliquot in PCR strip tubes, 10 ul per strip and freeze at −80 C In vitro transcription of guide RNA Kit protocol: Information may be accessed at the website worldwideweb.neb.com/products/e2030-hiscribe-t7-in-vitro-transcription-kit
- Take 100 uM stock oligo
- Anneal in 10 ul reaction:
  - 1 ul of T7 "forward" strand="XRP2649"
  - 1 ul of T7 "reverse" oligo
  - 1 ul TaqB buffer
  - 7 ul water Run the PNK PCR program without the 37° C. incubation step (basically heat up to 95° C. for 5 min and do slow cool to 4° C. but not as slow as surveyor anneal). Nanodrop annealed oligos: normalize with water to 500 ng/ul (usually 1000-2000 ng/ul for a 120nt oligo)

For T7 transcription follow kit instructions (but cut down size by 4×)
10 ul Reaction
- 1 ul 10× buffer
- 1 ul T7 transcriptase
- 0.5 ul rNTP
- 0.5 ul HMW mix
- 1 ul DNA template (annealed)
- 6 ul water Transcribe in 42° C. (preferably thermocycler) for at least 2-3 hours, let run overnight. Yield should be around 1000-2000 ng/ul of RNA. It is normal for white residues to form.

Preparation of DNA

For pUC19, linearize with HindIII and column purify will need 300-400 ng of plasmid per reaction, so cut amount necessary For gDNA, amplify wt cell DNA with PCR
do several PCR reactions, pool and column purify
concentrate the product so around 100-200 ng/ul
Keep at −20 C 20 ul Reaction
- 10 ul of lysate (this is pre-aliquoted)
- 2 ul of cleavage buffer (NEB buffer 3)
- 1 ul of RNA (directly from above; don't need to purify)
- 1 ul of DNA (from above)
- 6 ul of water Incubate at 37° C. for 1-2 hour (30 min is enough)

Column purify the reaction
Run out on a 2% E-gel

Figure 17:
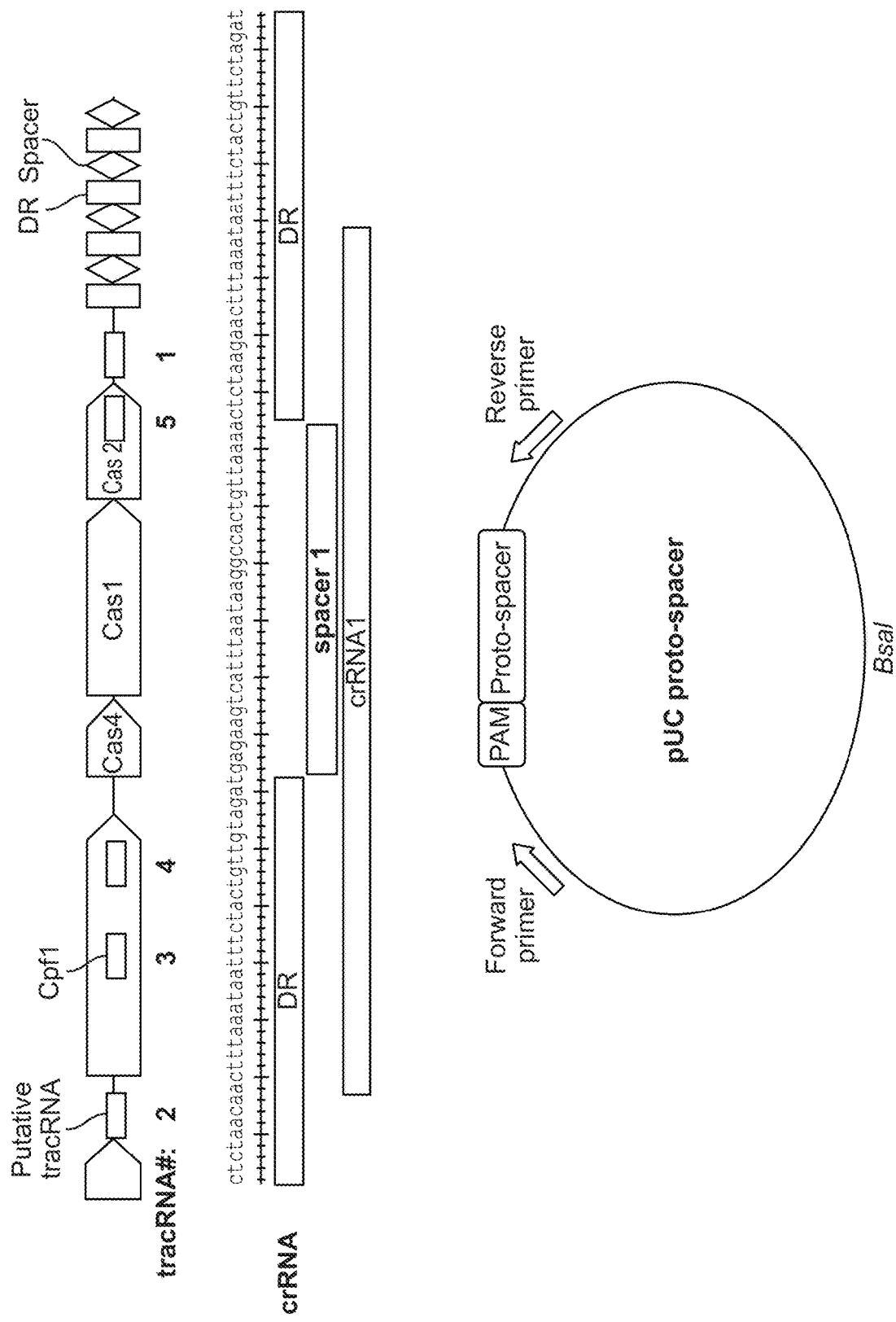
FIG. 17 shows a schematic indicating putative tracrRNA sequence positions in the FnCpf1 locus, the crRNA (SEQ ID NO: 391) and the pUC protospacer vector.
Figure 18:
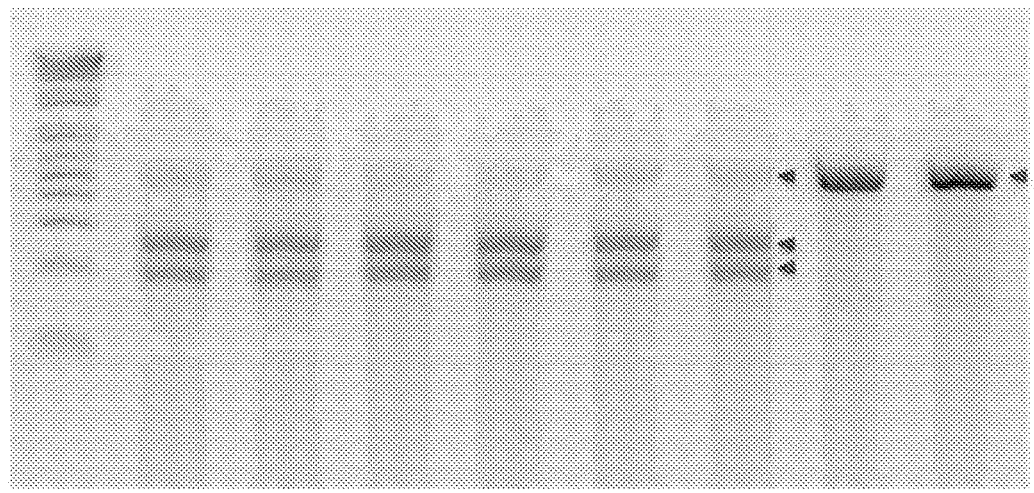
FIG. 18 is a gel showing the PCR fragment with TTa PAM and proto-spacer1 sequence incubated in cell lysate.
Figure 19:
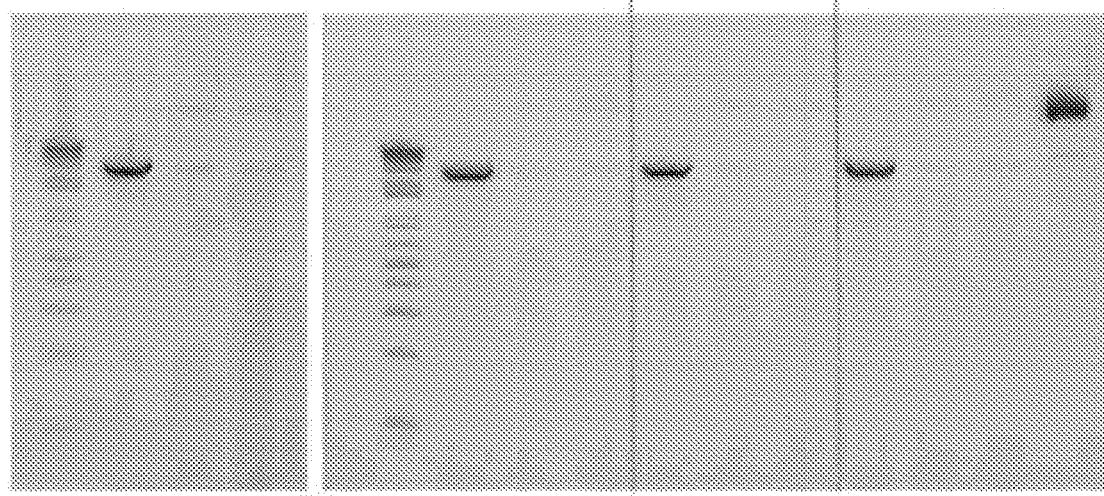
FIG. 19 is a gel showing the pUC-spacer1 with different PAMs incubated in cell lysate.
Figure 20:
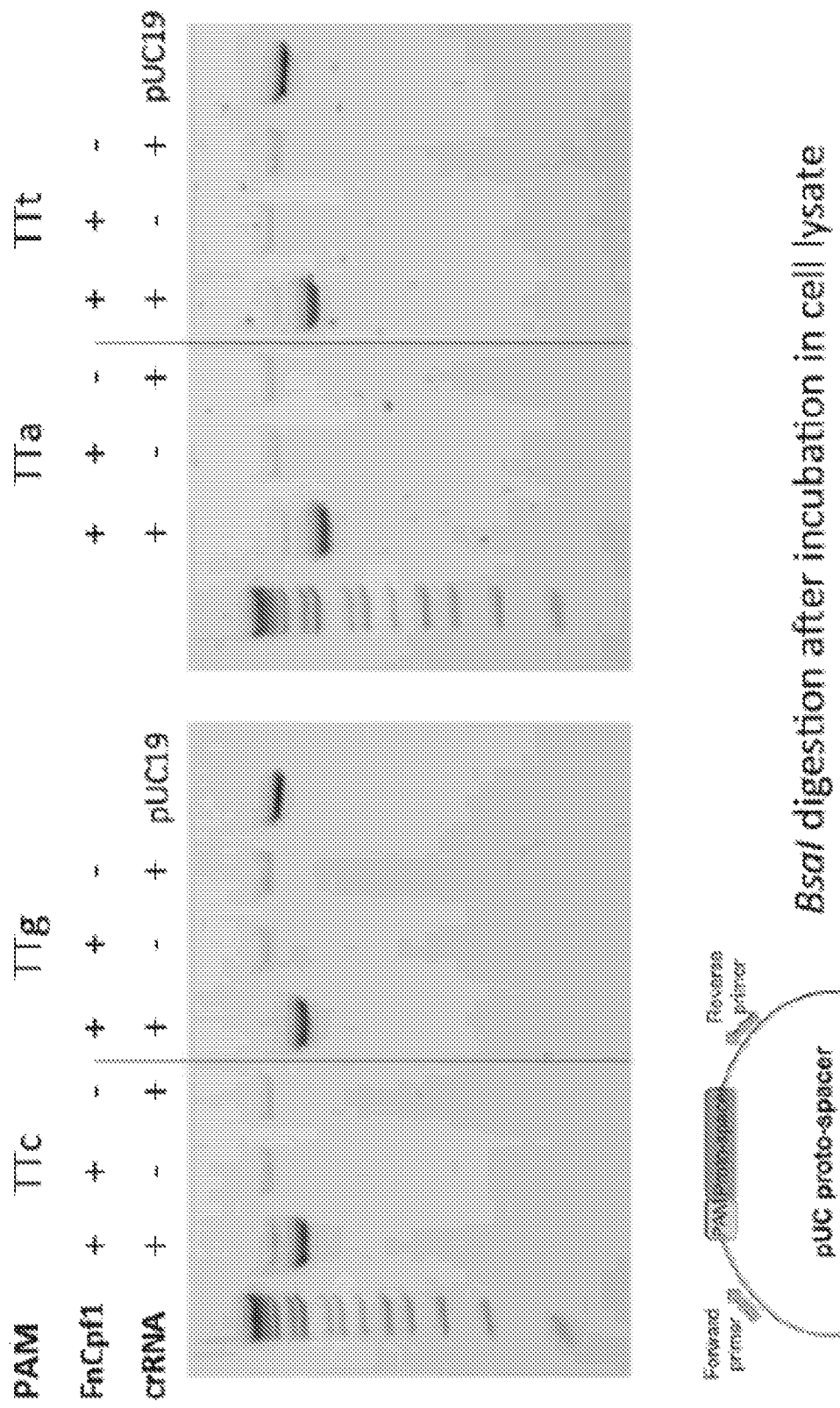
FIG. 20 is a gel showing the BasI digestion after incubation in cell lysate.
Figure 21:
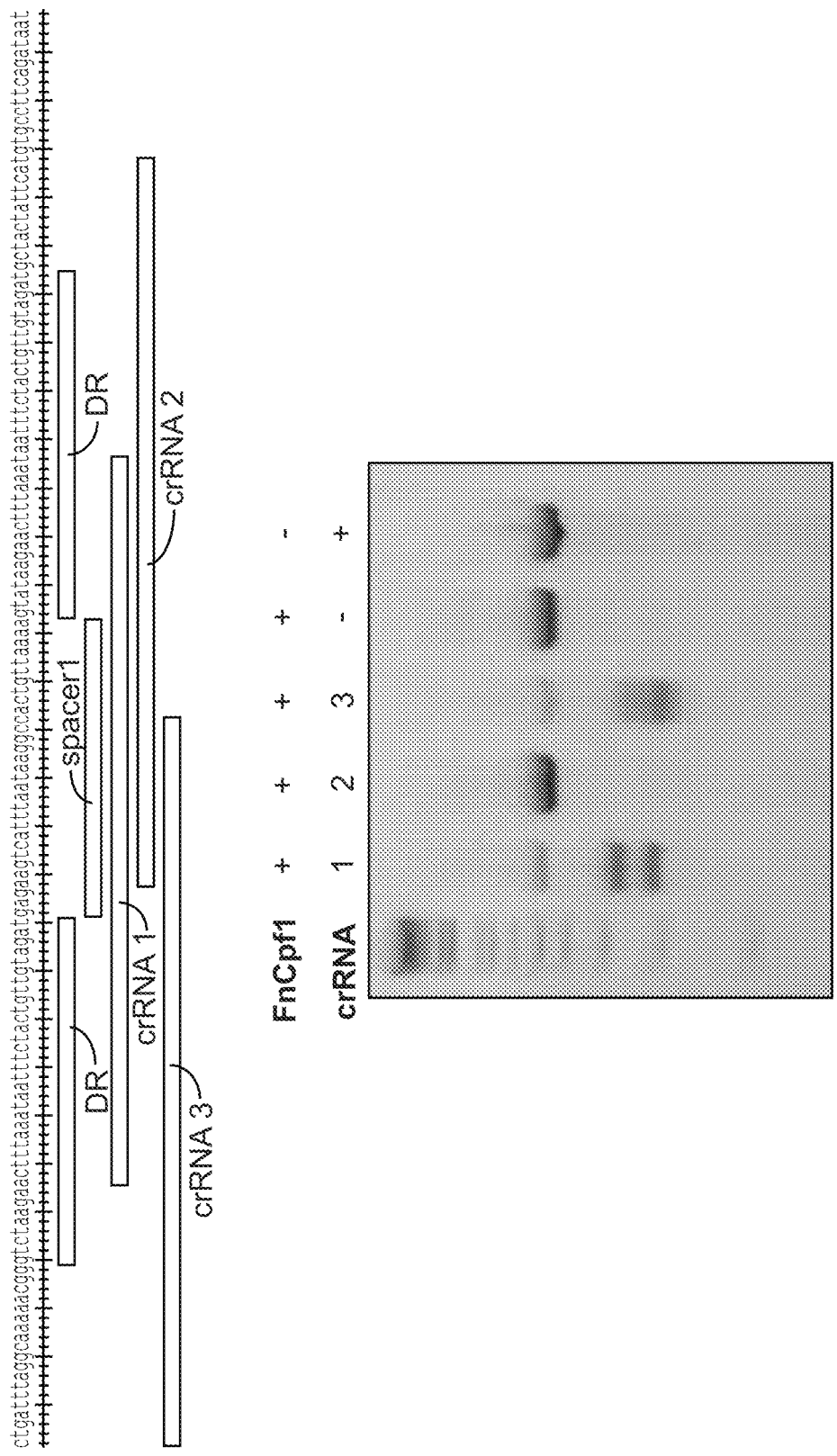
FIG. 21 is a gel showing digestion results for three putative crRNA sequences (SEQ ID NO: 392).

The cell lysate cleavage assay used tracrRNA at positions 1, 2, 3, 4 and 5 as indicated in FIG. 17. Cell Lysate Cleavage Assay (1) (FIG. 18) is a gel indicating the PCR fragment with a TTa PAM and proto-spacer1 sequence incubated in cell lysate. Cell Lysate Cleavage Assay (2) (FIG. 19) is a gel showing the pUC-spacer1 with different PAMs incubated in cell lysate. Cell Lysate Cleavage Assay (3) (FIG. 20) is a gel showing the BasI digestion after incubation in cell lysate. Cell Lysate Cleavage Assay (4) (FIG. 21) is a gel showing digestion results for three putative crRNA sequences.

Applicants also determined the effect of spacer length on cleavage efficiency. Applicants tested different lengths of spacer against a piece of target DNA containing the target site: 5'-TTAgagaagtcatttaataaggccactgttaaaa-3' (SEQ ID NO: 119). For this experiment, pUC19 plasmid containing the spacer (5'-TTcgagaagucauuuaauaaggccacuguuaaaa-3' (SEQ ID NO: 120)) was treated to the following conditions:

| | |
|---|---|
| 2 ul | cell lysate containing Cpf1 |
| 2 ul | pUC19 DNA with spacer (300 ng) |
| 1 ul | crRNA (500 ng) |
| 2 ul | NEBuffer 3 |
| 2 ul | 40 mM DTT |
| 0.3 ul | BsaI |
| 10.7 ul | ddH2O |

Figure 23:
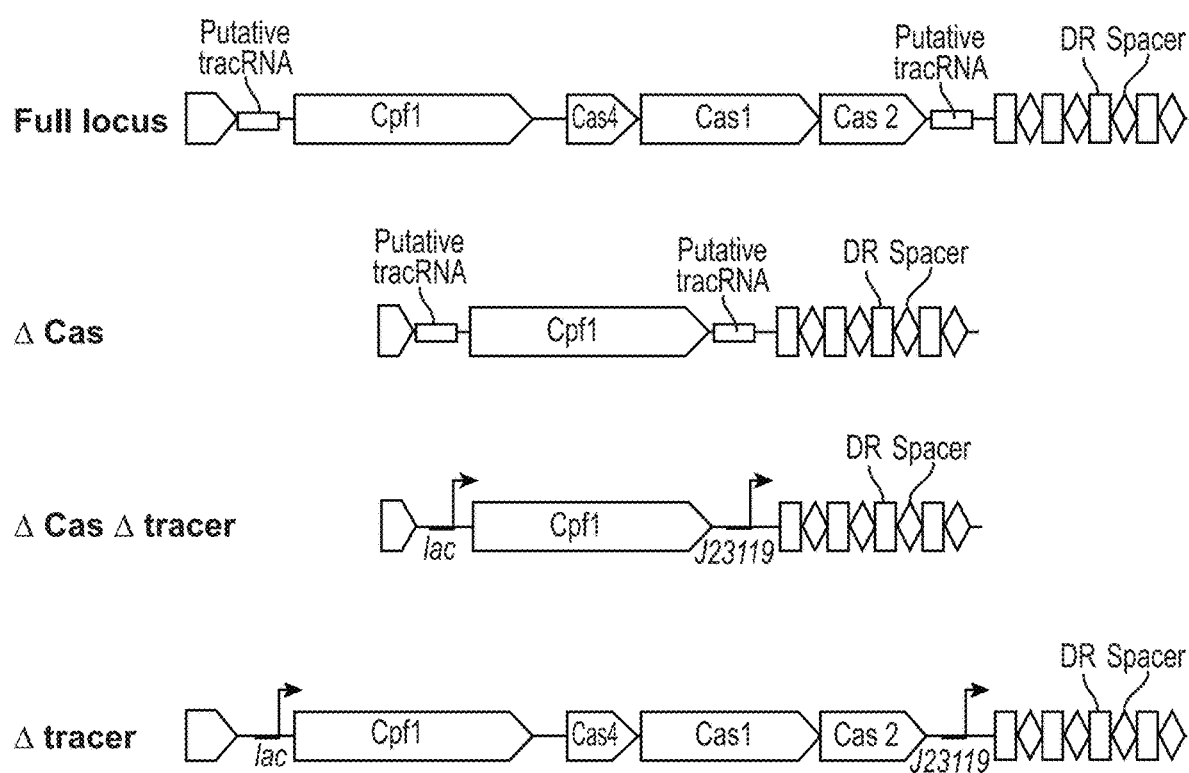
FIG. 23 is a schematic indicating the minimal FnCpf1 locus.
Figure 24:
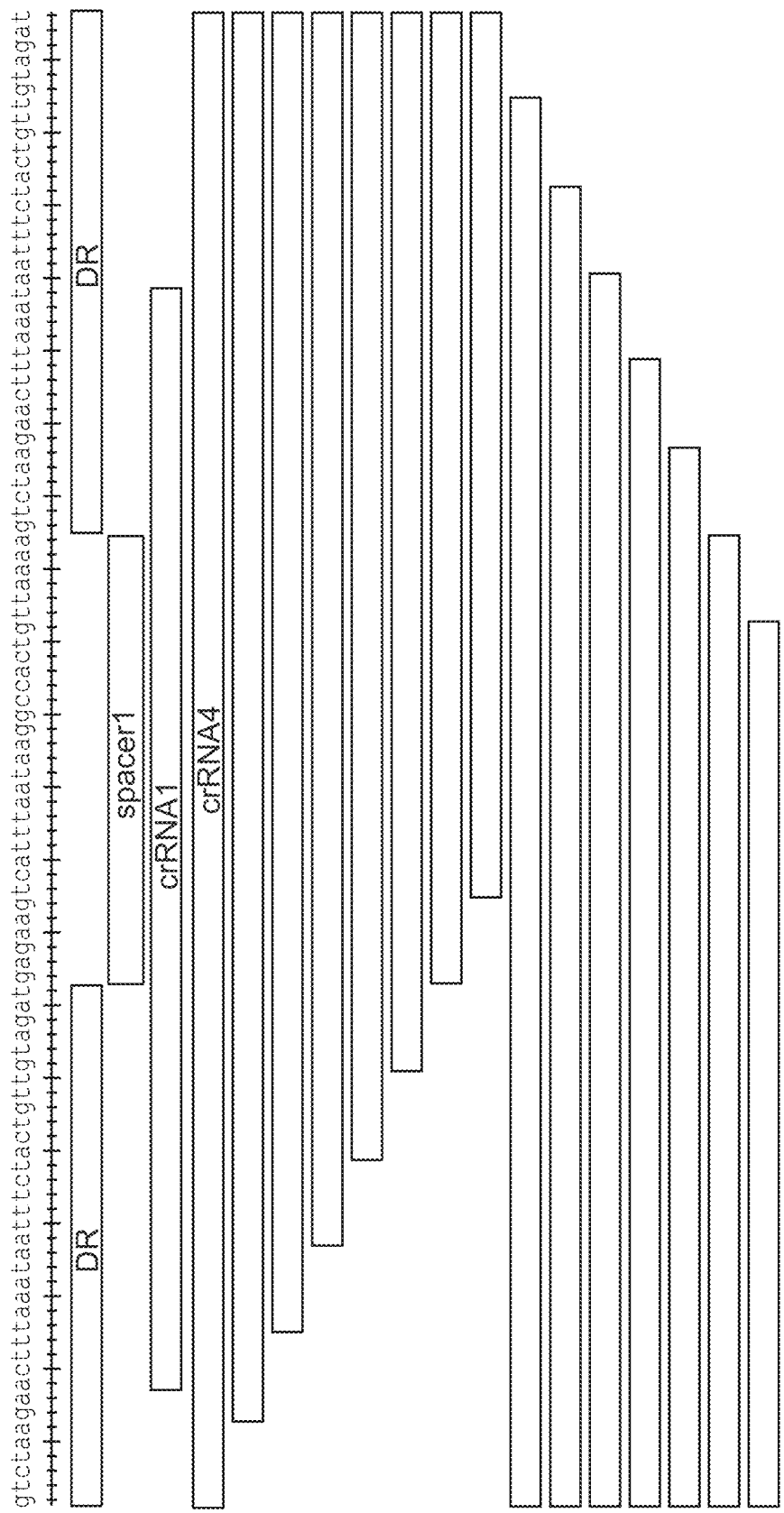
FIG. 24 is a schematic indicating the minimal Cpf1 guide (SEQ ID NO: 432).
Figure 25A:
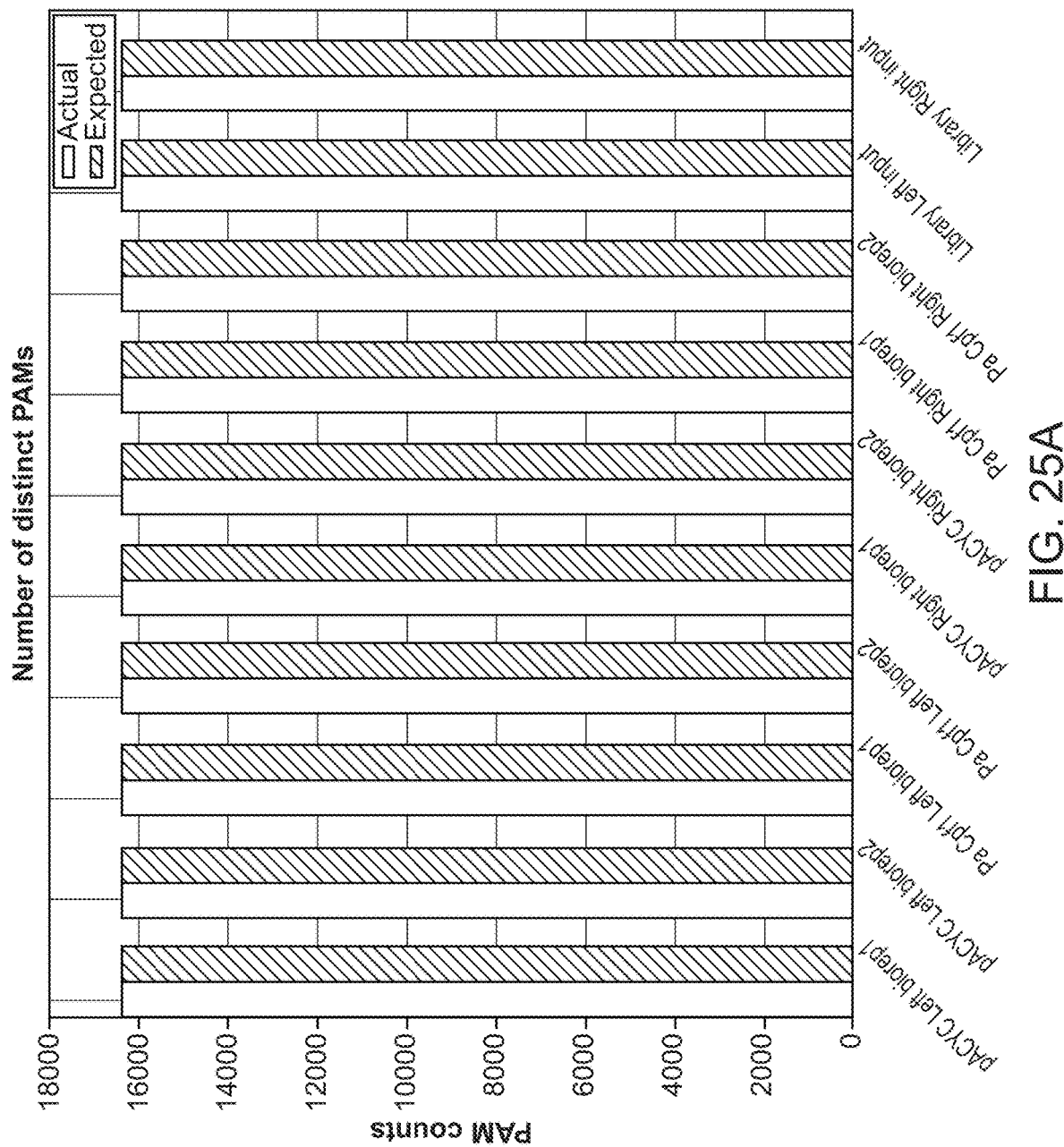
FIG. 25A-25E depicts PaCpf1 PAM Screen Computational Analysis. After sequencing of the screen DNA, the regions corresponding to either the left PAM or the right PAM were extracted. For each sample, the number of PAMs present in the sequenced library were compared to the number of expected PAMs in the library (4^7). (A) The left library showed very slight PAM depletion. To quantify this depletion, an enrichment ratio was calculated. For both conditions (control pACYC or PaCpf1 containing pACYC) the ratio was calculated for each PAM in the library as $$\text{ratio} = -\log_2 \frac{\text{sample} + 0.01}{\text{initial library} + 0.01}$$
Figure 25B:
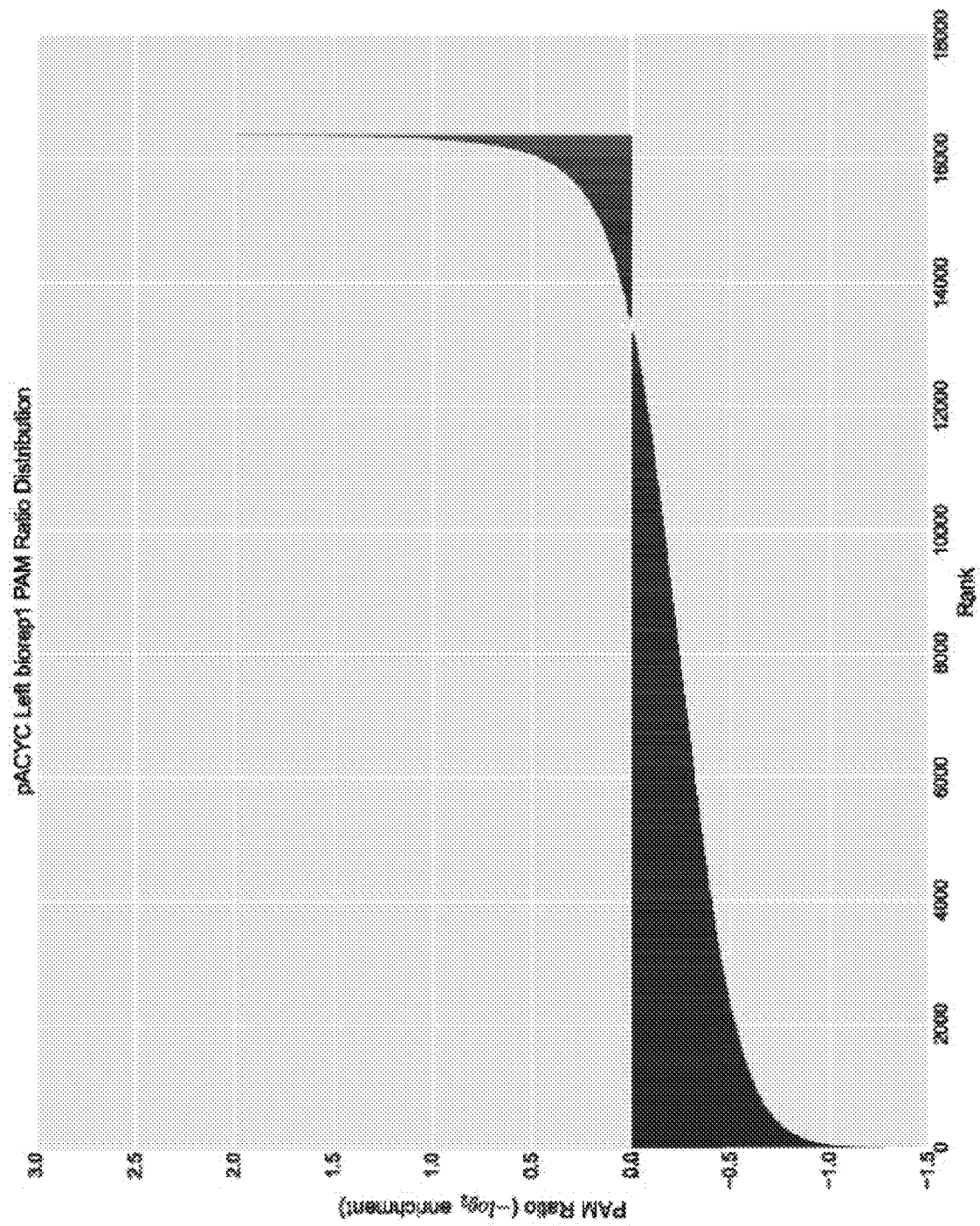
Figure 25C:
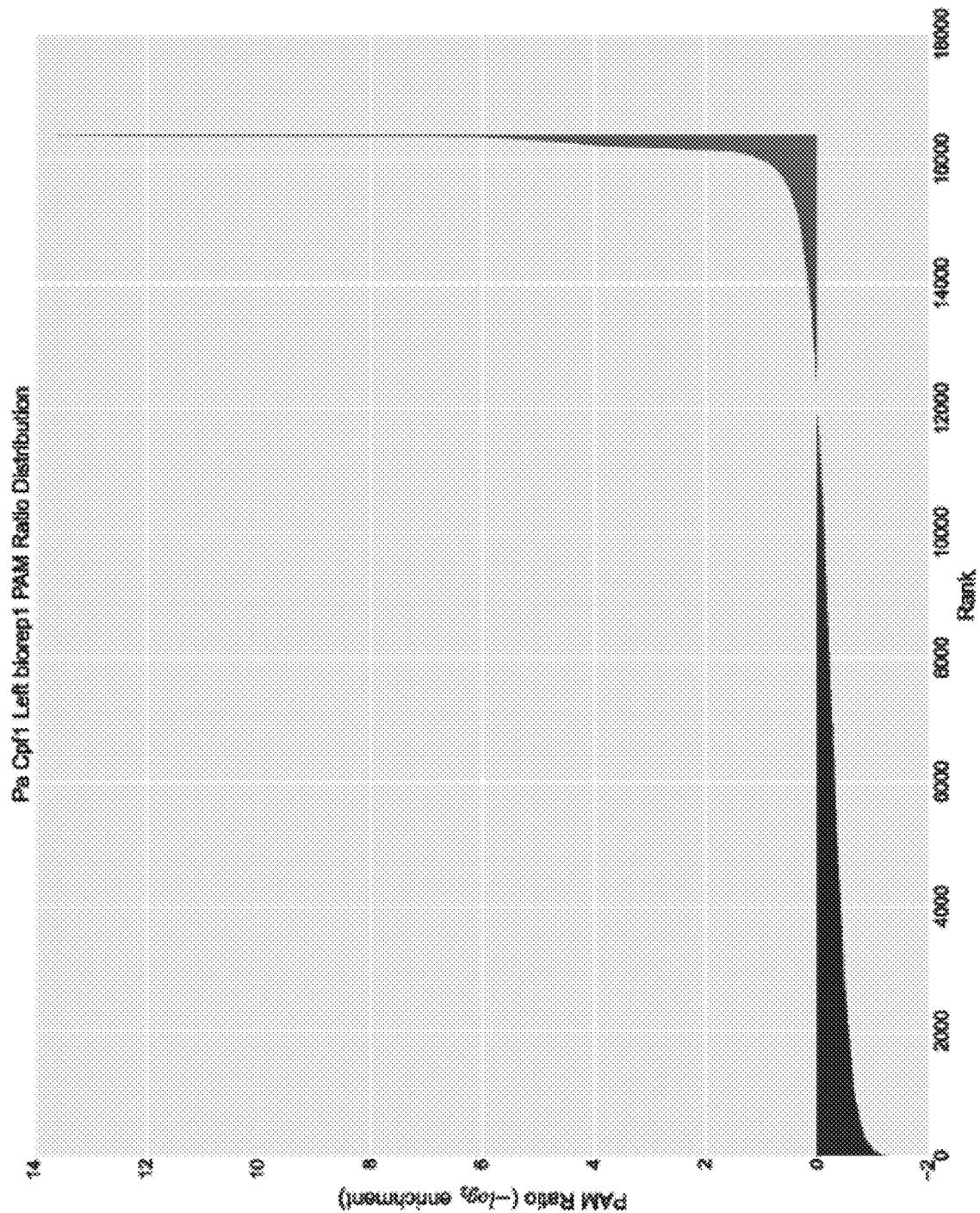
Figure 25D:
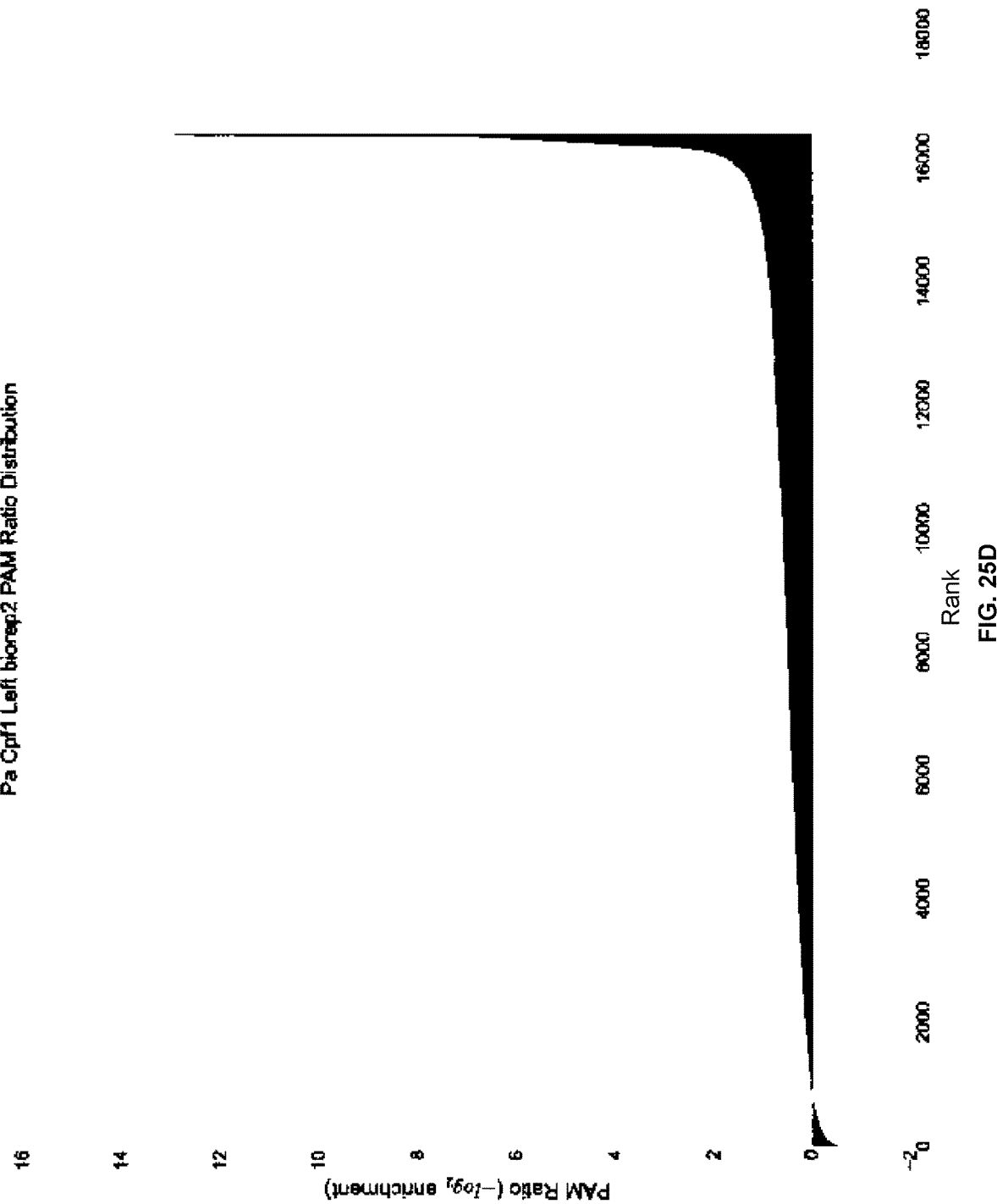
Figure 25E:
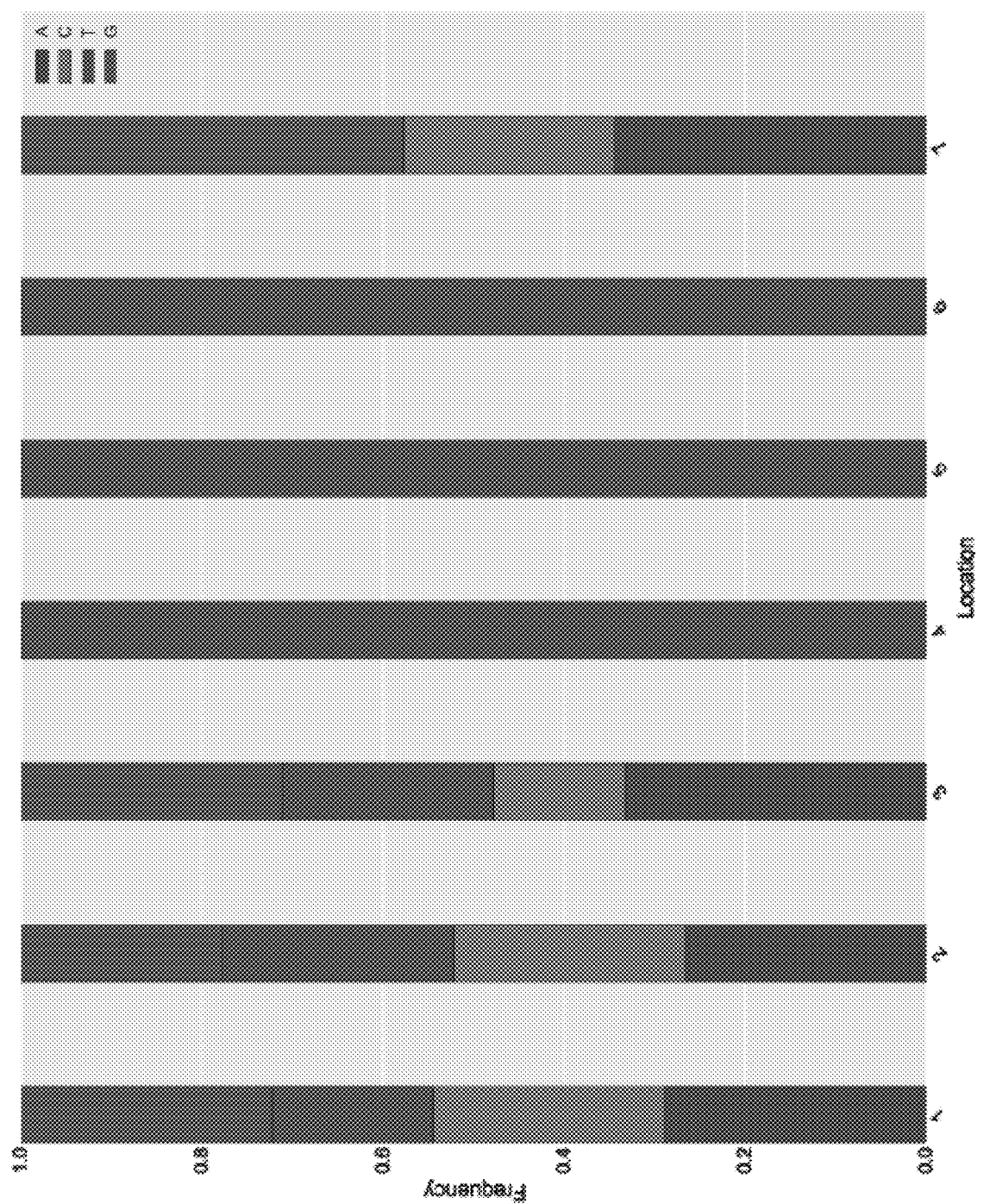

Incubated at 37 C for 30 minutes, followed by treatment with RNase for 5 minutes. Then the reaction was cleaned up using Qiagen PCR Purification Kit and analyzed on 2% Invitrogen E-gel EX. FIG. 22 is a gel showing that crRNAs 1-7 mediated successful cleavage of the target DNA in vitro with FnCpf1, whereas crRNAs 8-13 did not facilitate cleavage of the target DNA. Applicants arrived at the minimal Fn Cpf1 locus (FIG. 23) and also elucidated the minimal Cpf1 guide (FIG. 24). Applicants also cleaved a PCR amplicon of the human Emx1 locus (FIG. 44). The EMX amplicon was treated to the following conditions:

| | |
|---|---|
| 2 ul | cell lysate containing Cpf1 |
| 3 ul | pUC19 DNA with spacer (300 ng) |
| 1 ul | crRNA (500 ng) |
| 2 ul | NEBuffer 3 |
| 2 ul | 40 mM DTT |
| 0.3 ul | BsaI |
| 9.7 ul | ddH$_2$O |

Incubated at 37° C. for 30 minutes, followed by treatment with RNase for 5 minutes. Then the reaction was cleaned up using Qiagen PCR Purification Kit and analyzed on 2% Invitrogen E-gel EX.

Applicants further studied the effect of truncation in 5' DR on cleavage activity (FIG. 45A-B). For this experiment, pUC19 plasmid containing the spacer (5'-TTcgagaagu-cauuuaauaaggccacuguuaaaa-3' (SEQ ID NO: 121)) was treated to the following conditions:

| | |
|---|---|
| 2 ul | cell lysate containing Cpf1 |
| 2 ul | pUC19 DNA with spacer (300 ng) |
| 1 ul | crRNA (500 ng) |
| 2 ul | NEBuffer 3 |
| 2 ul | 40 mM DTT |
| 0.3 ul | BsaI |
| 10.7 ul | ddH2O |

Incubated at 37° C. for 30 minutes, followed by treatment with RNase for 5 minutes. Then the reaction was cleaned up using Qiagen PCR Purification Kit and analyzed on 2% Invitrogen E-gel EX. Applicants determined that crDNA deltaDR5 disrupted the stem loop at the 5' end and this shows that the stemloop at the 5' end is essential for cleavage activity (FIG. 45B).

Applicants investigated the effect of crRNA-DNA target mismatch on cleavage efficiency (FIG. 46). For this experiment, pUC19 plasmid containing the spacer (5'-TTcgagaagucauuuaauaaggccacuguuaaaa-3' (SEQ ID NO: 122)) was treated to the following conditions:

| | |
|---|---|
| 2 ul | cell lysate containing Cpf1 |
| 2 ul | pUC19 DNA with spacer (300 ng) |
| 1 ul | crRNA (500 ng) |
| 2 ul | NEBuffer 3 |
| 2 ul | 40 mM DTT |
| 0.3 ul | BsaI |
| 10.7 ul | ddH2O |

Incubated at 37 C for 30 minutes, followed by treatment with RNase for 5 minutes. Then the reaction was cleaned up using Qiagen PCR Purification Kit and analyzed on 2% Invitrogen E-gel EX. Each lane in the gel shown in FIG. 46 consists of Cpf1-containing cell lysate, pUC19 with TTc protospacer, and the corresponding crRNA, indicated as 1-11.

Applicants studied the FnCpf1p RuvC domain and have identified amino acid mutations that may convert the FnCpf1 effector protein into a nickase, whereby the effector protein has substantially reduced nuclease activity and only one strand of DNA is nicked and/or cleaved. The amino acid positions in the FnCpf1p RuvC domain include but are not limited to D917A, E1006A, E1028A, D1227A, D1255A, N1257A, D917A, E1006A, E1028A, D1227A, D1255A and N1257A. The amino acid positions in AsCpf1 correspond to AsD908A, AsE993A, AsD1263A. The amino acid positions in LbCpf1 correspond to LbD832A Applicants have also identified a putative second nuclease domain which is most similar to PD-(D/E)XK nuclease superfamily and HincII endonuclease like. The point mutations to be generated in this putative nuclease domain to substantially reduce nuclease activity include but are not limited to N580A, N584A, T587A, W609A, D610A, K613A, E614A, D616A, K624A, D625A, K627A and Y629A.

Applicants perform plasmid cleavage experiments with FnCpf1p and sequencing of said plasmids will provide information as to whether the cut site is sticky or blunt. Applicants will elucidate further details on the various domains of FnCpf1p from the crystal structure of this protein in a suitable complex. For optimization of FnCpf1 loci components for activity in human cells, Applicants will try different architectures of crRNAs and try more targets than described herein.

Applicants cleaved DNA using purified *Francisella* and *Prevotella* Cpf1 (FIG. 47). For this experiment, pUC19 plasmid containing the spacer (5'-TTcgagaagucauuuaauaaggccacuguuaaaa-3' (SEQ ID NO: 123)) was treated to the following conditions:

| | |
|---|---|
| 2 ul | purified protein solution |
| 2 ul | pUC19 DNA with spacer (300 ng) |
| 1 ul | crRNA (500 ng) |

-continued

| | |
|---|---|
| 2 ul | NEBuffer 3 |
| 2 ul | 40 mM DTT |
| 0.3 ul | BsaI |
| 10.7 ul | ddH2O |

Incubated at 37° C. for 30 minutes, followed by treatment with RNase for 5 minutes. Then the reaction was cleaned up using Qiagen PCR Purification Kit and analyzed on 2% Invitrogen E-gel EX. Alaysis of the gel shown in FIG. 47 indicates that PaCpf1 can work with FnCpf1 crRNA, although the activity is not as high as FnCpf1. Applicants concluded that this makes sense given the stem-loop sequences for PaCpf1 and FnCpf1 are almost identical (only 1 base difference) (see FIGS. 48A-B). This is further highlighted in the mature crRNA sequences for FnCpf1 and PaCpf1 shown in FIGS. 50A-B. In preferred embodiments of the invention, biochemical or in vitro cleavage may not require a tracr sequence for effective function of a Cpf1p CRISPR system. Inclusion of a stem loop or a further optimized stem loop structure is important for cleavage activity.

DNA cleavage by human codon optimized *Francisella novicida* FnCpf1p.

Applicants also showed that FnCpf1p cleaves DNA in human cells. 400 ng human codon optimized FnCpf1p and 100 ng U6::crRNA were transfected per well of HEK293T cells (~240,000 cells) in 24 well plates. Five crRNAs comprising spacer sequences of length 20-24nt based on 5'-ctgatggtccatgtctgttactcg-3' (SEQ ID NO: 124) (i.e., the first 20, 21, 22, 23, or all 24 nt) were employed. The crRNAs further comprised 20nt of the 5' repeat sequence of PaCpf1 at the 5' of the spacer. Applicants earlier determined that the repeat sequence from PaCpf1 can be recognized by FnCpf1.

DNA was harvested after ~60h and analyzed by SURVEYOR nuclease assay. The SURVEYOR primers for DNMT1 were 5'-ctgggactcaggcgggtcac-3' (SEQ ID NO: 125) (forward) and 5'-cctcacacaacagcttcatgtcagc-3' (SEQ ID NO: 126) (reverse). Cleaved DNA fragments coinciding with expected cleavage products of ~345 bp and ~261 bp were observed for all five crRNAs (spacer lengths 20-24nt). (FIG. 51).

Example 5: Further Validation Experiments for PaCpf1

A PAM computational screen was performed for *Prevotella albensis* Cpf1(PaCpf1) similar to the screen performed for FnCpf1 as detailed in Example 3. After sequencing of the screen DNA, the regions corresponding to either the left PAM or the right PAM were extracted. For each sample, the number of PAMs present in the sequenced library were compared to the number of expected PAMs in the library (4^7). The left library showed very slight PAM depletion. To quantify this depletion, an enrichment ratio was calculated. For both conditions (control pACYC or PaCpf1 containing pACYC) the ratio was calculated for each PAM in the library as $$\text{ratio} = -\log_2 \frac{\text{sample} + 0.01}{\text{initial library} + 0.01}$$

Plotting the distribution shows little enrichment in the control sample and enrichment in both bioreps. All PAMs above a ratio of 4.5 were collected, and the frequency distributions were plotted, revealing a 5' TTTV PAM, where V is A or C or G (FIG. 25A-E).

Applicants will elucidate further details on the various domains of PaCpf1p from the crystal structure of this protein in a suitable complex. For optimization of PaCpf1 loci components for activity in human cells, Applicants will work with different crRNA (guideRNA) architectures and different optimized PaCpf1 effector proteins. Applicants have human codon optimized the PaCpf1 sequence as follows:

```
NLS (underline)
GS linker (bold)
3xHA tag (italics)
                                          (SEQ ID NO: 127)
ATGGCCCCAAAGAAGAAGCGGAAGGTCGGTATCCACGGAGTCCCAGCAGC Cggtagt AACATCAAAAACTTTACCGGGCTCTACCCCCTCAGCAAAACTT

TGCGCTTTGAACTCAAGCCTATTGGCAAAACCAAGGAAAACATCGAGAAA

AATGGCATCCTGACCAAGGACGAGCAACGGGCTAAAGACTACCTCATAGT

CAAAGGCTTTATTGACGAGTATCACAAGCAGTTCATCAAAGACAGGCTTT

GGGACTTTAAATTGCCTCTCGAAAGTGAGGGGGAGAAGAACAGTCTCGAA

GAATACCAGGAACTGTACGAGCTCACTAAGCGCAACGATGCCCAGGAGGC

CGACTTCACCGAGATTAAAGATAACCTTCGCAGCTCTATTACCGAACAGC

TCACGAAGTCTGGATCTGCGTACGATCGGATTTTTAAAAAAGAGTTCATT

AGAGAAGACCTGGTCAACTTCCTCGAAGATGAAAAAGATAAAAATATCGT

GAAACAGTTCGAGGACTTTACTACATATTTTACGGGTTTTTATGAAAATA

GGAAGAACATGTACTCTAGCGAAGAGAAGTCCACGGCCATCGCATACCGG

CTTATCCATCAGAATCTGCCAAAATTCATGGACAACATGAGAAGTTTTGC

CAAAATTGCAAATTCCAGTGTTTCCGAGCACTTTAGCGACATCTATGAAA

GCTGGAAGGAATATCTGAATGTAAATAGCATCGAGGAAATCTTCCAGCTC

GACTATTTTAGCGAAACCTTGACTCAGCCACATATTGAGGTGTATAACTA

TATTATCGGGAAGAAAGTCCTGGAAGACGGAACCGAGATAAAGGGCATCA

ACGAGTATGTGAACCTCTACAATCAGCAGCAGAAAGATAAGAGTAAACGA

CTGCCTTTCCTGGTGCCACTGTATAAGCAAATTTTGTCTGATAGGGAAAA

ACTCTCCTGGATTGCTGAAGAGTTCGACAGCGACAAGAAGATGCTGAGCG

CTATCACCGAGTCTTACAACCACCTGCACAACGTGTTGATGGGTAACGAG

AACGAAAGCCTGCGAAATCTGCTGCTGAATATTAAGGACTATAACCTGGA

GAAAATTAATATCACAAACGACTTGTCTCTCACCGAAATCTCCCAGAATC

TTTTTGGCCGATATGATGTATTCACAAATGGGATCAAAAACAAGCTGAGA

GTGTTGACTCCAAGGAAGAAAAGGAGACGGACGAAAATTTTGAGGACCG

CATTAACAAAATTTTTAAGACCCAGAAGTCCTTCAGCATCGCTTTTCTGA

ACAAGCTGCCTCAGCCCGAAATGGAGGATGGGAAGCCCCGGAACATTGAG

GACTATTTCATTACACAGGGGGCGATTAACACCAAATCTATACAGAAAGA

AGATATCTTCGCCCAAATTGAGAATGCATACGAGGATGCACAGGTGTTCC

TGCAAATTAAGGACACCGACAACAAACTTAGCCAGAACAAGACGGCGGTG

GAAAAGATCAAAACTTTGCTGGACGCCTTGAAGGAACTCCAGCACTTCAT

CAAACCGCTGCTGGGCTCTGGGGAGGAGAACGAGAAAGACGAACTGTTCT

ACGGTTCCTTCCTGGCCATCTGGGACGAACTGGACACCATTACACCACTT

TATAACAAAGTGAGAAATTGGCTGACCCGAAAACCATATTCAACAGAAAA

AATCAAATTGAATTTCGACAACGCTCAGCTGCTGGGAGGGTGGGATGTCA

ATAAAGAACACGACTGTGCAGGTATCTTGTTGCGGAAAAACGATAGCTAC

TATCTCGGAATTATCAATAAGAAAACCAACCACATCTTTGATACGGATAT

TACGCCATCAGATGGCGAGTGCTATGACAAAATCGACTACAAGCTCCTTC

CCGGGGCGAACAAAATGCTTCCAAAGGTGTTTTTTAGTAAGTCCCGAATC

AAAGAGTTCGAGCCATCAGAGGCCATAATCAATTGCTATAAGAAGGGGAC

ACACAAAAAAGGAAAAAACTTTAACCTGACGGACTGTCACCGCCTGATCA

ACTTTTTTAAGACCTCAATCGAGAAACACGAGGATTGGTCAAAATTCGGA

TTCAAGTTCTCCGATACCGAAACGTATGAGGATATTAGCGGTTTTTATAG

AGAGGTCGAGCAGCAGGGATACAGGCTGACGAGCCATCCAGTCAGTGCCA

GCTATATACATAGTCTGGTCAAGGAAGGAAAACTGTACCTCTTCCAAATC

TGGAACAAGGACTTTTCTCAATTCTCCAAGGGGACCCCTAACTTGCACAC

TCTCTATTGGAAGATGCTGTTTGACAAACGGAATCTTAGCGATGTGGTTT

ATAAGCTGAATGGCCAGGCTGAAGTGTTCTATAGAAAGAGCTCCATTGAA

CACCAGAACCGAATTATCCACCCCGCTCAGCATCCCATCACAAATAAGAA

TGAGCTTAACAAAAAGCACACTAGCACCTTCAAATACGATATCATCAAAG

ATCGCAGATACACGGTGGATAAATTCCAGTTCCATGTGCCCATTACTATA

AATTTTAAGGCGACCGGGCAGAACAACATCAACCCAATCGTCCAAGAGGT

GATTCGCCAAAACGGTATCACCCACATCATAGGCATCGATCGAGGTGAAC

GCCATCTTCTGTACCTCTCTCTCATCGATTTGAAAGGCAACATCATCAAG

CAGATGACTCTCAACGAAATTATTAATGAGTATAAGGGTGTGACCTATAA

GACCAACTACCATAACCTCCTGGAGAAGAGGGAGAAGGAGCGGACCGAGG

CCAGACACTCCTGGAGTAGTATTGAAAGCATAAAAGAACTGAAGGATGGA

TACATGTCACAGGTGATTCACAAAATTACGGACATGATGGTTAAGTACAA

TGCGATTGTGGTCCTGGAGGACCTCAACGGGGGGTTTATGCGAGGCCGCC

AGAAGGTCGAGAAGCAGGTGTACCAGAAATTTGAAAAAAAGTTGATCGAC

AAGCTGAACTATCTCGTTGACAAGAAACTCGACGCTAACGAGGTCGGCGG

AGTACTGAATGCTTATCAGCTGACCAACAAGTTCGAGTCTTTCAAGAAGA

TTGGGAAACAAAGCGGATTTTTGTTCTACATCCCCGCCTGGAACACAAGC

AAAATCGATCCTATAACAGGGTTCGTTAATCTGTTCAACACCAGGTACGA

GTCTATCAAGGAGACAAAAGTTTTTTGGTCTAAGTTTGATATTATCCGAT

ACAATAAAGAGAAGAATTGGTTCGAGTTCGTCTTCGATTACAATACCTTT

ACGACTAAAGCGGAGGGAACACGCACTAAGTGGACTCTGTGCACCCACGG

CACTCGCATCCAGACATTCCGGAACCCAGAAAAGAATGCCCAGTGGGACA

ATAAAGAGATCAATTTGACTGAGTCCTTCAAAGCTCTGTTTGAAAGTAC

AAGATCGATATCACCAGTAATCTCAAGGAATCCATCATGCAGGAAACCGA

GAAGAAGTTCTTCCAGGAACTGCATAATCTGCTCCACCTGACCCTGCAGA

TGAGGAATAGCGTTACTGGAACCGACATAGACTATTTGATCAGCCCCGTT
```

-continued

GCCGATGAGGATGGAAATTTCTATGATAGTCGCATAAATGGCAAAAATTT

TCCGGAGAATGCCGATGCCAATGGCGCGTACAACATCGCACGAAAGGGTC

TGATGCTTATTCGGCAGATCAAGCAAGCAGATCCACAGAAGAAATTCAAG

TTTGAGACAATCACCAATAAAGACTGGCTGAAATTCGCCCAAGACAAGCC

CTATCTTAAAGATggcagcgggAAAAGGCCGGCGGCCACGAAAAAGGCCG

GCCAGGCAAAAAAGAAAAAGggatccTACCCATACGATGTTCCAGATTAC

GCTTATCCCTACGACGTGCCTGATTATGCATACCCATACGATGTCCCCGA

CTATGCCTAA

The vector map for human codon optimized PaCpf1 sequence is provided in FIG. 26.

Example 6: Cpf1 Orthologs

Applicants analyzed an expanding pool of Cpf1 orthologs (FIG. 27). Human codon optimized sequences were obtained for several Cpf1 loci components (FIGS. 28-42). Applicants also arrived at the Direct Repeat (DR) sequences for each ortholog and their predicted fold structure (FIG. 43A-I).

Applicants further study Cpf1 orthologs based on size of the effector protein, i.e. smaller effector proteins allow for easier packaging into vectors and on PAM composition. All aspects allow for further optimization in prokaryotic and eukaryotic cells, preferably for effective activity in mammalian cells, i.e. human cells.

Applicants showed that the effector protein orthologs of the following loci showed activity in the in vitro cleavage assay: Peregrinibacteria bacterium GW2011_GWA2_33_10 Cpf1, Acidaminococcus sp. BV3L6 Cpf1, Francisella tularensis 1 Cpf1, Moraxella bovoculi 237 Cpf1, Lachnospiraceae bacterium ND2006 Cpf1, Lachnospiraceae bacterium MA2020 Cpf1, Porphyromonas macacae Cpf1, Porphyromonas crevlorlcanls 3 Cpf1, Prevotella albensis Cpf1 (FIG. 27).

In the in vitro cleavage assay by orthologs, HEK293 cells expressing Cpf1 orthologs were harvested and the lysate was incubated with predicted mature crRNA targeting an artificial spacer cloned into the pUC19 plasmids. The spacer was preceded by 8 degenerate bases to allow for determination of the PAM via sequencing. The lower bands signify cleavage by the Cpf1 enzyme (FIG. 52).

Applicants identified computationally derived PAMs from the in vitro cleavage assay (FIG. 53). Uncut DNA from FIG. 52 (the higher band) was excised and amplified for next generation sequencing. The abundance of each 8-mer was calculated and the log ratio compared to the input library was used to quantify enrichment. Individual 8-mers with a log ratio greater than 4 were compiled and used to determine the consensus PAM using Weblogo.

Applicants further identified that Cpf1p effector proteins cut in a staggered fashion with 5' overhangs. Purified FnCpf1 protein was harvested and incubated with crRNA and the corresponding target cloned into pUC19. The cleaved product was gel extracted and submitted for Sanger sequencing. The asymmetric reads show that there is a staggered cut (FIG. 54). In a preferred embodiment of the invention, Applicants demonstrate in vivo staggered ligation with a template (e.g. an exogenous template).

Applicants also determined the effect of spacer length on the cutting ability of the effector protein (FIG. 55). Purified FnCpf1 protein was harvested and incubated with crRNA and the corresponding target cloned into pUC19. Spacer lengths greater than 17 nt cut to completion, while the 17 nt spacer shows reduced activity and spacers less than 17 nt are not active.

Applicants demonstrated that FnCpf1 mediates indel formation in HEK293T cells.

~280,000 HEK cells/24 well were transfected with 350 ng of huFnCpf1 plasmid and 150 ng U6::crRNA. Cells were harvested three days after transfection and analyzed by SURVEYOR nuclease assay. Uncleaved PCR fragment size is 606 bps. Expected fragment sizes are ~418 bp and ~188 bp for crRNA DNMT1-1 and ~362 bp and ~244 bp for crRNA DNMT 1-3 (FIG. 56).

DNMT1-1 spacer sequence: cctcactcctgctcggtgaattt (SEQ ID NO: 128)

DNMT1-3 spacer sequence: ctgatggtccatgtctgttactc (SEQ ID NO: 129)

Applicants identified the required components of the Cpf1 system to achieve cleavage by determining if transcripts were processed when certain sequences of the locus were deleted (FIG. 57A-F). The deleted sequences may include but are not limited to the Cas1 gene, the Cas2 gene and the tracr. Hence, in a preferred embodiment of the invention, Applicants demonstrated that the tracr is not a required component of a functional Cpf1 system or complex to achieve cleavage.

Example 7: Procedures

Generation of Heterologous Plasmids

To generate the FnCpf1 locus for heterologous expression, genomic DNA from *Francisella Novicida* was PCR amplified using Herculase II polymerase (Agilent Technologies) and cloned into pACYC-184 using Gibson cloning (New England Biolabs). Cells harboring plasmids were made competent using the Z-competent kit (Zymo).

Bacterial RNA-Sequencing

RNA was isolated from stationary phase bacteria by first resuspending *F. novicida* (generous gift from David Weiss) or *E. coli* in TRIzol and then homogenizing the bacteria with zirconia/silica beads (BioSpec Products) in a BeadBeater (BioSpec Products) for 3 one-minute cycles. Total RNA was purified from homogenized samples with the Direct-Zol RNA miniprep protocol (Zymo), DNase treated with TURBO DNase (Life Technologies), and 3' dephosphorylated with T4 Polynucleotide Kinase (New England Biolabs). rRNA was removed with the bacterial Ribo-Zero rRNA removal kit (Illumina). RNA libraries were prepared from rRNA-depleted RNA using NEBNext® Small RNA Library Prep Set for Illumina (New England Biolabs) and size selected using the Pippin Prep (Sage Science)

For heterologous *E. coli* expression of the FnCpf1 locus, RNA sequencing libraries were prepared from rRNA-depleted RNA using a derivative of the previously described CRISPR RNA sequencing method (Heidrich et al., 2015). Briefly, transcripts were poly-A tailed with *E. coli* Poly(A) Polymerase (New England Biolabs), ligated with 5' RNA adapters using T4 RNA Ligase 1 (ssRNA Ligase) High Concentration (New England Biolabs), and reverse transcribed with AffinityScript Multiple Temperature Reverse Transcriptase (Agilent Technologies). cDNA was PCR amplified with barcoded primers using Herculase II polymerase (Agilent Technologies) RNA-sequencing analysis The prepared cDNA libraries were sequenced on a MiSeq (Illumina). Reads from each sample were identified on the basis of their associated barcode and aligned to the appropriate RefSeq reference genome using BWA (Li and Durbin, In Vivo FnCpf1 PAM Screen Randomized PAM plasmid libraries were constructed using synthesized oligonucleotides (IDT) consisting of 7 randomized nucleotides either upstream or downstream of the spacer 1 target. The randomized ssDNA oligos were made double stranded by annealing to a short primer and using the large Klenow fragment (New England Biolabs) for second strand synthesis. The dsDNA product was assembled into a linearized pUC19 using Gibson cloning (New England Biolabs). Competent Stbl3 E. coli (Invitrogen) were transformed with the cloned products, and more than $10^7$ cells were collected and pooled. Plasmid DNA was harvested using a Maxi-prep kit (Qiagen). We transformed 360 ng of the pooled library into E. coli cells carrying the FnCpf1 locus or pACYC184 control. After transformation, cells were plated on ampicillin. After 16 hours of growth, $>4*10^6$ cells were harvested and plasmid DNA was extracted using a Maxi-prep kit (Qiagen). The target PAM region was amplified and sequenced using a MiSeq (Illumina) with single-end 150 cycles.

Computational PAM Discovery Pipeline

PAM regions were extracted, counted, and normalized to total reads for each sample. For a given PAM, enrichment was measured as the log ratio compared to pACYC184 control, with a 0.01 psuedocount adjustment. PAMs above a 3.5 enrichment threshold were collected and used to generate sequence logos (Crooks et al., 2004).

PAM Validation

Sequences corresponding to both PAMs non-PAMs were cloned into digested pUC19 and ligated with T4 ligase (Enzymatics). Competent E. coli with either the FnCpf1 locus plasmid or pACYC184 control plasmid were transformed with 20 ng of PAM plasmid and plated on LB agar plates supplemented with ampicillin and chloramphenicol. Colonies were counted after 18 hours.

Synthesis of crRNAs and gRNAs

All crRNA and gRNAs used in vitro were synthesized using the HiScribe™ T7 High Yield RNA Synthesis Kit (NEB). ssDNA oligos corresponding to the reverse complement of the target RNA sequence were synthesized from IDT and annealed to a short T7 priming sequence. T7 transcription was performed for 4 hours and then RNA was purified using the MEGAclear™ Transcription Clean-Up Kit (Ambion).

Purification of Cpf1 Protein

FnCpf1 protein was cloned into a bacterial expression vector (6-His-MBP-TEV-Cpf1, a pET based vector kindly given to Applicants by Doug Daniels) ("6-His" disclosed as SEQ ID NO: 130). Two liters of Terrific Broth growth media with 100 µg/mL ampicillin was inoculated with 10 mL overnight culture Rosetta (DE3) pLyseS (EMD Millipore) cells containing the Cpf1 expression construct. Growth media plus inoculant was grown at 37° C. until the cell density reached 0.2 OD600, then the temperature was decreased to 21° C. Growth was continued until OD600 reached 0.6 when a final concentration of 500 µM IPTG was added to induce MBP-Cpf1 expression. The culture was induced for 14-18 hours before harvesting cells and freezing at −80° C. until purification.

Cell paste was resuspended in 200 mL of Lysis Buffer (50 mM Hepes pH 7, 2M NaCl, 5 mM MgCl2, 20 mM imidazole) supplemented with protease inhibitors (Roche cOmplete, EDTA-free) and lysozyme. Once homogenized, cells were lysed by sonication (Branson Sonifier 450) then centrifuged at 10,000 g for 1 hour to clear the lysate. The lysate was filtered through 0.22 micron filters (Millipore, Stericup) and applied to a nickel column (HisTrap FF, 5 mL), washed, and then eluted with a gradient of imidazole. Fractions containing protein of the expected size were pooled, TEV protease (Sigma) was added, and the sample was dialyzed overnight into TEV buffer (500 mM NaCl, 50 mM Hepes pH 7, 5 mM MgCl, 2 mM DTT). After dialysis, TEV cleavage was confirmed by SDS-PAGE, and the sample was concentrated to 500 µL prior to loading on a gel filtration column (HiLoad 16/600 Superdex 200) via FPLC (AKTA Pure). Fractions from gel filtration were analyzed by SDS-PAGE; fractions containing Cpf1 were pooled and concentrated to 200 µL and either used directly for biochemical assays or frozen at −80° C. for storage. Gel filtration standards were run on the same column equilibrated in 2M NaCl, Hepes pH 7.0 to calculate the approximate size of FnCpf1.

Generation of Cpf1 Protein Lysate

Cpf1 proteins codon optimized for human expression were synthesized with an N-terminal nuclear localization tag and cloned into the pcDNA3.1 expression plasmid by Genscript. 2000 ng of Cpf1 expression plasmids were transfected into 6-well plates of HEK293FT cells at 90% confluency using Lipofectamine 2000 reagent (Life Technologies). 48 hours later, cells were harvested by washing once with DPBS (Life Technologies) and scraping in lysis buffer [20 mM Hepes pH 7.5, 100 mM KCl, 5 mM MgCl2, 1 mM DTT, 5% glycerol, 0.1% Triton X-100, 1× cOmplete Protease Inhibitor Cocktail Tablets (Roche)]. Lysate was sonicated for 10 minutes in a Biorupter sonicator (Diagenode) and then centrifuged. Supernatant was frozen for subsequent use in in vitro cleavage assays.

In Vitro Cleavage Assay

Cleavage in vitro was performed either with purified protein or mammalian lysate with protein at 37° C. in cleavage buffer (NEBuffer 3, 5 mM DTT) for 20 minutes. The cleavage reaction used 500 ng of synthesized crRNA or sgRNA and 200 ng of target DNA. Target DNA involved either protospacers cloned into pUC19 or PCR amplicons of gene regions from genomic DNA isolated from HEK293 cells. Reactions were cleaned up using PCR purification columns (Qiagen) and run on 2% agarose E-gels (Life Technologies). For native and denaturing gels to analyze cleavage by nuclease mutants, cleaned-up reactions were run on TBE 6% polyacrylamide or TBE-Urea 6% polyacrylamide gels (Life Technologies)

In Vitro Cpf1-Family Protein PAM Screen

In vitro cleavage reactions with Cpf1-family proteins were run on 2% agarose E-gels (Life Technologies). Bands corresponding to un-cleaved target were gel extracted using QIAquick Gel Extraction Kit (Qiagen) and the target PAM region was amplified and sequenced using a MiSeq (Illumina) with single-end 150 cycles. Sequencing results were entered into the PAM discovery pipeline.

Activity of Cpf1 Cleavage in 293FT Cells

Cpf1 proteins codon optimized for human expression were synthesized with an N-terminal nuclear localization tag and cloned into the pcDNA3.1 CMV expression plasmid by Genscript. PCR amplicons comprised of a U6 promoter driving expression of the crRNA sequence were generated using Herculase II (Agilent Technologies). 400 ng of Cpf1 expression plasmids and 100 ng of the crRNA PCR products were transfected into 24-well plates of HEK293FT cells at 75-90% confluency using Lipofectamine 2000 reagent (Life Technologies). Genomic DNA was harvested using QuickExtract™ DNA Extraction Solution (Epicentre).

SURVEYOR Nuclease Assay for Genome Modification

293FT cells were transfected with 400 ng Cpf1 expression plasmid and 100 ng U6::crRNA PCR fragments using Lipofectamin 2000 reagent (Life Technologies). Cells were incubated at 37° C. for 72 h post-transfection before genomic DNA extraction. Genomic DNA was extracted using the QuickExtract DNA Extraction Solution (Epicentre) following the manufacturer's protocol. The genomic region flanking the CRISPR target site for each gene was PCR amplified, and products were purified using QiaQuick Spin Column (Qiagen) following the manufacturer's protocol. 200-500 ng total of the purified PCR products were mixed with 1 μl 10× Taq DNA Polymerase PCR buffer (Enzymatics) and ultrapure water to a final volume of 10 μl, and subjected to a re-annealing process to enable heteroduplex formation: 95° C. for 10 min, 95° C. to 85° C. ramping at −2° C./s, 85° C. to 25° C. at −0.25° C./s, and 25° C. hold for 1 min. After reannealing, products were treated with SURVEYOR nuclease and SURVEYOR enhancer S (Integrated DNA Technologies) following the manufacturer's recommended protocol, and analyzed on 4-20% Novex TBE polyacrylamide gels (Life Technologies). Gels were stained with SYBR Gold DNA stain (Life Technologies) for 10 min and imaged with a Gel Doc gel imaging system (Bio-rad). Quantification was based on relative band intensities. Indel percentage was determined by the formula, $100 \times (1-(1-(b+c)/(a+b+c))^{1/2})$, where a is the integrated intensity of the undigested PCR product, and b and c are the integrated intensities of each cleavage product.

Deep Sequencing to Characterize Cpf1 Indel Patterns in 293FT Cells

HEK293FT cells were transfected and harvested as described for assessing activity of Cpf1 cleavage. The genomic region flanking DNMT1 targets were amplified using a two-round PCR region to add Illumina P5 adapters as well as unique sample-specific barcodes to the target amplicons. PCR products were ran on 2% E-gel (Invitrogen) and gel-extracted using QiaQuick Spin Column (Qiagen) as per the manufacturer's recommended protocol. Samples were pooled and quantified by Qubit 2.0 Fluorometer (Life Technologies). The prepared cDNA libraries were sequenced on a MiSeq (Illumina). Indels were mapped using a Python implementation of the Geneious 6.0.3 Read Mapper.

Computational Analysis of Cpf1 Loci

PSI-BLAST program (Altschul et al., 1997) was used to identify Cpf1 homologs in the NCBI NR database using several known Cpf1 sequences as queries with the Cpf1 with the E-value cut-off of 0.01 and low complexity filtering and composition based statistics turned off. The TBLASTN program with the E-value cut-off of 0.01 and low complexity filtering turned off parameters was used to search the NCBI WGS database using the Cpf1 profile Makarova et al., 2015) as the query. Results of all searches were combined. The HHpred program was used with default parameters to identify remote sequence similarity using a subset of representative Cpf1 sequences queries (Soding et al., 2006). Multiple sequence alignment were constructed using MUSCLE (Edgar, 2004) with manual correction based on pairwise alignments obtained using PSI-BLAST and HHpred programs. Phylogenetic analysis was performed using the FastTree program with the WAG evolutionary model and the discrete gamma model with 20 rate categories (Price et al., 2010). Protein secondary structure was predicted using Jpred 4 (Drozdetskiy et al., 2015).

CRISPR repeats were identified using PILER-CR (Edgar, 2007) and CRISPRfinder (Grissa et al., 2007). The spacer sequences were searched against the NCBI nucleotide NR databases using MEGABLAST (Morgulis et al., 2008) with default parameters except that the word size was set at 20 and E-value cutoff 0.0001.

TABLE 1

Endogenous F. novicida spacer sequences

| Spacer number | Sequence |
|---|---|
| 1 | GAGAAGTCATTTAATAAGGCCACTGTTAAAA (SEQ ID NO: 131) |
| 2 | GCTACTATTCCTGTGCCTTCAGATAATTCA (SEQ ID NO: 132) |
| 3 | GTCTAGAGCCTTTTGTATTAGTAGCCG (SEQ ID NO: 133) |

TABLE 2 ssDNA oligos and primer for generation of PAM library

| Oligo/primer name | Sequence |
|---|---|
| PAM library 5' (+) | GGCCAGTGAATTCGAGCTCGGTACCCGGG NNNNNNNNGAGAAGTCATTTAATAAGGCC ACTGTTAAAAAGCTTGGCGTAATCATGGT CATAGCTGTTT (SEQ ID NO: 134) |
| PAM library 3' (+) | GGCCAGTGAATTCGAGCTCGGTACCCGGG GAGAAGTCATTTAATAAGGCCACTGTTAA AANNNNNNNNAGCTTGGCGTAATCATGGT CATAGCTGTTT (SEQ ID NO: 135) |
| PAM library (−) | GCTGACATGAAGCTGTTGTGTGAGG (SEQ ID NO: 136) |

TABLE 3

Primers used for pUC19 sequencing and SURVEYOR assay

| Primer name | Sequence |
|---|---|
| NGS pUC For | GGCCAGTGAATTCGAGCTCGG (SEQ ID NO: 137) |
| NGS pUC Rev | CAATTTCACACAGGAAACAGCTATGACC (SEQ ID NO: 138) |
| Sanger pUC For | CGGGGCTGGCTTAACTATGCG (SEQ ID NO: 139) |
| Sanger pUC Rev | GCCCAATACGCAAACCGCCT (SEQ ID NO: 140) |
| EMX1 For | CCATCCCCTTCTGTGAATGT (SEQ ID NO: 141) |
| EMX1 Rev | TCTCCGTGTCTCCAATCTCC (SEQ ID NO: 142) |
| DNMT1 For | CTGGGACTCAGGCGGGTCAC (SEQ ID NO: 143) |
| DNMT1 Rev | GCTGACATGAAGCTGTTGTGTGAGG (SEQ ID NO: 144) |

TABLE 4

Truncated guides for in vitro cleavage assay

| Truncated guide number | Sequence |
|---|---|
| 1 | GAGAAGTCATTTAATAAGGCCACT (SEQ ID NO: 145) |
| 2 | GAGAAGTCATTTAATAAGGCCA (SEQ ID NO: 146) |
| 3 | GAGAAGTCATTTAATAAGGC (SEQ ID NO: 147) |
| 4 | GAGAAGTCATTTAATAAG (SEQ ID NO: 148) |
| 5 | GAGAAGTCATTTAATAA (SEQ ID NO: 149) |
| 6 | GAGAAGTCATTTAATA (SEQ ID NO: 150) |

TABLE 5

Mismatched guides for in vitro cleavage assay

| Mismatched guide number | Sequence |
|---|---|
| 1 | GATAAGTCATTTAATAAGGCCACT (SEQ ID NO: 151) |
| 2 | GAGAAGGCATTTAATAAGGCCACT (SEQ ID NO: 152) |
| 3 | GAGAAGTCATGTAATAAGGCCACT (SEQ ID NO: 153) |
| 4 | GAGAAGTCATTTAAGAAGGCCACT (SEQ ID NO: 154) |
| 5 | GAGAAGTCATTTAATAAGTCCACT (SEQ ID NO: 155) |
| 6 | GAGAAGTCATTTAATAAGGCCAAT (SEQ ID NO: 156) |

TABLE 6

Truncated direct repeat guides for in vitro cleavage assay

| Direct repeat length | Sequence |
|---|---|
| +18 | ATTTCTACTGTTGTAGATGAGAAGTCATTTAATAAGGCCACT (SEQ ID NO: 157) |
| +17 | TTTCTACTGTTGTAGATGAGAAGTCATTTAATAAGGCCACT (SEQ ID NO: 158) |
| +16 | TTCTACTGTTGTAGATGAGAAGTCATTTAATAAGGCCACT (SEQ ID NO: 159) |
| +15 | TCTACTGTTGTAGATGAGAAGTCATTTAATAAGGCCACT (SEQ ID NO: 160) |

TABLE 6-continued

Truncated direct repeat guides for in vitro cleavage assay

| Direct repeat length | Sequence |
|---|---|
| +11 | CTGTTGTAGATGAGAAGTCATTTAATAAGGCCACT (SEQ ID NO: 161) |
| +7 | TGTAGATGAGAAGTCATTTAATAAGGCCACT (SEQ ID NO: 162) |

TABLE 7

Direct repeat stem mutations for in vitro cleavage assay

| Direct repeat stem mutant number | Sequence |
|---|---|
| 1 | AATTTCTGCTGTTGCAGAT (SEQ ID NO: 163) |
| 2 | AATTTCCACTGTTGTGGAT (SEQ ID NO: 164) |
| 3 | AATTCCTACTGTTGTAGGT (SEQ ID NO: 165) |
| 4 | AATTTATACTGTTGTAGAT (SEQ ID NO: 166) |
| 5 | AATTTCGACTGTTGTAGAT (SEQ ID NO: 167) |
| 6 | AATTTCTAGTGTTGTAGAT (SEQ ID NO: 168) |

TABLE 8

Direct repeat loop mutations for in vitro cleavage assay

| Direct repeat loop mutant number | Sequence |
|---|---|
| 1 | AATTTCTACTATTGTAGAT (SEQ ID NO: 169) |
| 2 | AATTTCTACTGCTGTAGAT (SEQ ID NO: 170) |
| 3 | AATTTCTACTTTGTAGAT (SEQ ID NO: 171) |
| 4 | AATTTCTACTTGTAGAT (SEQ ID NO: 172) |
| 5 | AATTTCTACTTTTGTAGAA (SEQ ID NO: 173) |
| 6 | AATTTCTACTTTTGTAGAC (SEQ ID NO: 174) |

TABLE 9

Ortholog specific DNMT1 targeting guides for mammalian cells

| Nuclease | Name | 5' Direct Repeat | Sequence |
|---|---|---|---|
| AsCpf1 | DNMT1 target 1 | 5' Direct Repeat | Sequence |
| AsCpf1 | DNMT1 target 2 | TAATTTCTACTGTTGTAGAT (SEQ ID NO: 175) | CCTCACTCCTGC TCGGTGAATTT (SEQ ID NO: 176) |
| AsCpf1 | DNMT1 target 3 | TAATTTCTACTGTTGTAGAT (SEQ ID NO: 177) | AGGAGTGTTCAG TCTCCGTGAAC (SEQ ID NO: 178) |
| AsCpf1 | DNMT1 target 4 | TAATTTCTACTGTTGTAGAT (SEQ ID NO: 179) | CTGATGGTCCAT GTCTGTTACTC (SEQ ID NO: 180) |
| Lb3Cpf1 | DNMT1 target 1 | TAATTTCTACTGTTGTAGAT (SEQ ID NO: 181) | TTTCCCTTCAGCT AAAATAAAGG (SEQ ID NO: 182) |
| Lb3Cpf1 | DNMT1 target 2 | TAATTTCTACTAAGTGTAGAT (SEQ ID NO: 183) | CCTCACTCCTGC TCGGTGAATTT (SEQ ID NO: 184) |
| Lb3Cpf1 | DNMT1 target 3 | TAATTTCTACTAAGTGTAGAT (SEQ ID NO: 185) | AGGAGTGTTCAG TCTCCGTGAAC (SEQ ID NO: 186) |
| Lb3Cpf1 | DNMT1 target 4 | TAATTTCTACTAAGTGTAGAT (SEQ ID NO: 187) | CTGATGGTCCAT GTCTGTTACTC (SEQ ID NO: 188) |
| SpCas9 | DNMT1 target 1 | TAATTTCTACTAAGTGTAGAT (SEQ ID NO: 189) | TTTCCCTTCAGCT AAAATAAAGG (SEQ ID NO: 190) |
| SpCas9 | DNMT1 target 2 | na | TCACTCCTGCTC GGTGAATT (SEQ ID NO: 191) |
| SpCas9 | DNMT1 target 3 | na | AACCCTCTGGGG ACCGTTTG (SEQ ID NO: 192) |
| SpCas9 | DNMT1 target 4 | na | AGTACGTTAATG TTTCCTGA (SEQ ID NO: 193) |

TABLE 10

Ortholog specific direct repeats for crRNAs targeting proto-spacer 1 and DNMT1 target 3

| Direct repeat origin | Sequence |
|---|---|
| FnCpf1 | TAATTTCTACTGTTGTAGAT (SEQ ID NO: 195) |
| Lb1Cpf1 | AGAAATGCATGGTTCTCATGC (SEQ ID NO: 196) |
| BpCpf1 | AAAATTACCTAGTAATTAGGT (SEQ ID NO: 197) |
| PeCpf1 | GGATTTCTACTTTTGTAGAT (SEQ ID NO: 198) |
| PbCpf1 | AAATTTCTACTTTTGTAGAT (SEQ ID NO: 199) |
| SsCpf1 | CGCGCCCACGCGGGGCGCGAC (SEQ ID NO: 200) |
| AsCpf1 | TAATTTCTACTCTTGTAGAT (SEQ ID NO: 201) |
| Lb2Cpf1 | GAATTTCTACTATTGTAGAT (SEQ ID NO: 202) |
| CMtCpf1 | GAATCTCTACTCTTTGTAGAT (SEQ ID NO: 203) |
| EeCpf1 | TAATTTCTACTTTGTAGAT (SEQ ID NO: 204) |
| MbCpf1 | AAATTTCTACTGTTTGTAGAT (SEQ ID NO: 205) |
| LiCpf1 | GAATTTCTACTTTTGTAGAT (SEQ ID NO: 206) |
| Lb3Cpf1 | TAATTTCTACTAAGTGTAGAT (SEQ ID NO: 207) |
| PcCpf1 | TAATTTCTACTATTGTAGAT (SEQ ID NO: 208) |
| PdCpf1 | TAATTTCTACTTCGGTAGAT (SEQ ID NO: 209) |
| PmCpf1 | TAATTTCTACTATTGTAGAT (SEQ ID NO: 210) |

Example 8: Cloning of *Francisella tularensis* Subsp. *Novicida* U112 Cpf1 (FnCpf1)

Applicants cloned the *Francisella tularensis* subsp. *novicida* U112 (FIG. 58A) Cpf1 (FnCpf1) locus into low-copy plasmids (pFnCpf1) to allow heterologous reconstitution in *Escherichia coli*. Typically, in currently characterized CRISPR-Cas systems, there are two requirements for DNA interference: (i) the target sequence has to match one of the spacers present in the respective CRISPR array, and (ii) the target sequence complementary to the spacer (hereinafter protospacer) has to be flanked by the appropriate Protospacer-Adjacent Motif (PAM). Given the completely uncharacterized functionality of the FnCpf1 CRISPR locus, a plasmid depletion assay was designed to ascertain the activity of Cpf1 and identify PAM sequence and its respective location relative to the protospacer (5' or 3') (FIG. 58B). Two libraries of plasmids carrying a protospacer matching the first spacer in the FnCpf1 CRISPR array were constructed with the 5' or 3' 7 bp sequences randomized. Each plasmid library was transformed into *E. coli* that heterologously expressed the FnCpf1 locus or into a control *E. coli* strain carrying the empty vector. Using this assay, the PAM sequence and location was determined by identifying nucleotide motifs that are preferentially depleted in cells heterologously expressing the FnCpf1 locus. The PAM for FnCpf1 was found to be located upstream of the 5' end of displaced strand of the protospacer and has the sequence 5'-TTN (FIGS. 58C-D and 65). The 5' location of the PAM is also observed in type I CRISPR systems, but not in type II systems, where Cas9 employs PAM sequences that are on the 3' end of the protospacer (Mojica et al., 2009; Garneau et al., 2010). Beyond the identification of the PAM, the results of the depletion assay clearly indicate that heterologously expressed Cpf1 loci are capable of efficient interference with plasmid DNA. To further characterize the PAM, plasmid interference activity was analyzed by transforming cpf1-locus expressing cells with plasmids carrying protospacer 1 flanked by 5'-TTN PAMs. All 5'-TTN PAMs were efficiently targeted. In addition, 5'-CTA but not 5'-TCA was also efficiently targeted (FIG. 58E), suggesting that the middle T is more critical for PAM recognition than the first T and that, in agreement with the sequence motifs depleted in the PAM discovery assay (FIG. 65D), the PAM might be more relaxed than 5'-TTN.

Example 9: The Cpf1 CRISPR Array is Processed Independent of tracrRNA

Small RNAseq was used to determine the exact identity of the crRNA produced by the cpf1-based CRISPR loci. By sequencing small RNAs extracted from a *Francisella tularensis* subsp. *novicida* U112 culture, it was found that the CRISPR array is processed into short mature crRNAs of 42-44 nt in length. Each mature crRNA begins with 19 nt of the direct repeat followed by 23-25 nt of the spacer sequence (FIG. 59A). This crRNA arrangement contrasts with that in type II CRISPR-Cas systems where the mature crRNA begins with 20-24 nt of spacer sequence followed by ~22 nt of direct repeat (Deltcheva et al., 2011; Chylinski et al., 2013). Unexpectedly, apart from the crRNAs, we did not observe any robustly expressed small transcripts near the *Francisella* cpf1 locus that might correspond to tracrRNAs, which are associated with Cas9-based systems.

To confirm that no additional RNAs are required for crRNA maturation and DNA interference, an expression plasmid was constructed using synthetic promoters to drive the expression of *Francisella* cpf1 (FnCpf1) and the CRISPR array (pFnCpf1 min). Small RNAseq of *E. coli* expressing this plasmid still showed robust processing of the CRISPR array into mature crRNA (FIG. 59B), indicating that FnCpf1 and its CRISPR array are sufficient to achieve crRNA processing. Furthermore, *E. coli* expressing pFnCpf1_min as well as pFnCpf1_ΔCas, a plasmid with all of the cas genes removed but retaining native promoters driving the expression of FnCpf1 and the CRISPR array, also exhibited robust DNA interference, demonstrating that FnCpf1 and crRNA are sufficient for mediating DNA targeting (FIG. 59C). By contrast, Cas9 requires both crRNA and tracrRNA to mediate targeted DNA interference (Deltcheva et al., 2011; Zhang et al., 2013).

Example 10: Cpf1 is a Single crRNA-Guided Endonuclease

The finding that FnCpf1 can mediate DNA interference with crRNA alone is highly surprising given that Cas9 recognizes crRNA through the duplex structure between crRNA and tracrRNA (Jinek et al., 2012; Nishimasu et al., 2014), as well as the 3' secondary structure of the tracrRNA (Hsu et al., 2013; Nishimasu et al., 2014). To ensure that crRNA is indeed sufficient for forming an active complex with FnCpf1 and mediating RNA-guided DNA cleavage, FnCpf1 supplied only with crRNA was tested for target DNA cleavage in vitro. Purified FnCpf1 (FIG. 66) was assayed for its ability to cleave the same protospacer 1-containing plasmid used in the bacterial DNA interference experiments (FIG. 60A). FnCpf1 with an in vitro transcribed mature crRNA targeting protospacer 1 was able to efficiently cleave the target plasmid in a $Mg^{2+}$- and crRNA-dependent manner (FIG. 60B). Moreover, FnCpf1 was able to cleave both supercoiled and linear target DNA (FIG. 60C). These results clearly demonstrate the sufficiency of FnCpf1 and crRNA for RNA-guided DNA cleavage.

The cleavage site of FnCpf1 was also mapped using Sanger sequencing of the cleaved DNA ends. FnCpf1-mediated cleavage results in a 5-nt 5' overhang (FIGS. 60A, 60D, and 67), which is distinct from the blunt cleavage product generated by Cas9 (Garneau et al., 2010; Jinek et al., 2012; Gasiunas et al., 2012). The staggered cleavage site of FnCpf1 is distant from the PAM: cleavage occurs after the 18th base on the non-targeted (+) strand and after the 23rd base on the targeted (−) strand (FIGS. 60A, 60D, and 67). Using double-stranded oligo substrates with different PAM sequences, we also found that FnCpf1 cleave the target DNA when the 5'-TTN PAM to be in a duplex form (FIG. 60E), in contrast to the PAMs of Cas9 (Sternberg et al., 2014).

Example 11: The RuvC-Like Domain of Cpf1 Mediates RNA-Guided DNA Cleavage

The RuvC-like domain of Cpf1 retains all the catalytic residues of this family of endonucleases (FIGS. 61A and 68) and is thus predicted to be an active nuclease. Three mutants, FnCpf1(D917A), FnCpf1(E1006A), and FnCpf1(D1225A) (FIG. 61A) were generated to test whether the conserved catalytic residues are essential for the nuclease activity of FnCpf1. The D917A and E1006A mutations completely inactivated the DNA cleavage activity of FnCpf1, and D1255A significantly reduced nucleolytic activity (FIG. 61B). D908A, E993A, D1263A completely inactivated AsCpf1 protein and D832A, E925A, D947A or D1180A completely inactivated LbCpf1 (data not shown). These results are in contrast to the mutagenesis results for *Streptococcus pyogenes* Cas9 (SpCas9), where mutation of the RuvC (D11A) and HNH (N863A) nuclease domains converts SpCas9 into a DNA nickase (i.e. inactivation of each of the two nuclease domains abolished the cleavage of one of the DNA strands) (Jinek et al., 2012; Gasiunas et al., 2012) (FIG. 61B). These findings suggest that the RuvC-like domain of FnCpf1 cleaves both strands of the target DNA, perhaps in a dimeric configuration (FIG. 66B).

Example 12: Sequence and Structure of the Cpf1 crRNA

Compared with the guide RNA for Cas9, which has elaborate RNA secondary structure features that interact with Cas9 (Nishimasu et al., 2014), the guide RNA for FnCpf1 is notably simpler
and only comprises a single stem loop in the direct repeat sequence (FIG. 60A). The sequence and structural requirements of crRNA for mediating DNA cleavage with FnCpf1 were explored. The length of the guide sequence was examined. A 16 nt guide sequence was observed to achieve detectable DNA cleavage and guide sequences of 18 nt achieved efficient DNA cleavage in vitro (FIG. 62A). These lengths are similar to those demonstrated for SpCas9 where a 16 to 17 nt spacer sequence is sufficient for DNA cleavage (Cencic et al., 2014; Fu et al., 2014). The seed region of the FnCpf1 guide RNA was observed within the first 6 or 7 nt on the 5' end of the spacer sequence (FIG. 62B).

The effect of direct repeat mutations on the RNA-guided DNA cleavage activity was investigated. The direct repeat portion of mature crRNA is 19 nt long (FIG. 59A). Truncation of the direct repeat revealed that 16nt is sufficient, but optimally more than 17 nt of the direct repeat is effective for cleavage. Mutations in the stem loop that preserved the RNA duplex did not affect the cleavage activity, whereas mutations that disrupted the stem loop duplex structure abolished cleavage (FIG. 62D). Finally, base substitutions in the loop region did not affect nuclease activity, whereas substitution of the U immediately 5' of the spacer sequence reduced activity substantially. Collectively, these results suggest that FnCpf1 recognizes the crRNA through a combination of sequence-specific and structural features of the stem loop.

Example 13: Cpf1-Family Proteins from Diverse Bacteria Share Common crRNA Structures and PAMs To investigate the use of Cpf1 as a genome editing tool, the diversity of Cpf1-family proteins available in the public sequences databases was exploited. A BLAST search of the WGS database at the NCBI revealed 46 non-redundant Cpf1-family proteins (FIG. 27). 16 were chosen based on our phylogenetic reconstruction (FIG. 64), as representative of Cpf1 diversity (FIGS. 63A-63B and 69). These Cpf1-family proteins span a range of lengths between ~1200 and ~1500 amino acids.

The direct repeat sequences for each of these Cpf1-family proteins show strong conservation in the 19 nucleotides at the 3' of the direct repeat, the portion of the repeat that is included in the processed crRNA (FIG. 63C). The 5' sequence of the direct repeat is much more diverse. Of the 16 Cpf1-family proteins chosen for analysis, three (2—*Lachnospiraceae bacterium* MC2017, Lb3Cpf1; 3—*Butyrivibrio proteoclasticus*, BpCpf1; and 6—*Smithella* sp. SC_K08D17, SsCpf1) were associated with direct repeat sequences that are notably divergent from the FnCpf1 direct repeat (FIG. 63C). Notably, these direct repeat sequences preserved stem loop structures that were identical or nearly-identical to the FnCpf1 direct repeat (FIG. 63D).

Orthologous direct repeat sequences are tested for the ability to support FnCpf1 nuclease activity in vitro. Direct repeats that contained conserved stem sequences were able to function interchangeably with FnCpf1. The direct repeat from candidate 3 (BpCpf1) supported a low level of FnCpf1 nuclease activity (FIG. 63E), possibly due to the conservation of the 3'-most U.

An in vitro PAM identification assay (FIG. 70A) was used to determine the PAM sequence for each Cpf1-family protein. PAM sequences were identified for 7 new Cpf1-family proteins (FIGS. 63E and 70B-C), and the screen confirmed the PAM for FnCpf1 as 5'-TTN. The PAM sequences for the Cpf1-family proteins were predominantly T-rich, varying primarily in the number of Ts constituting each PAM (FIGS. 63F and 70B-C).

Example 14: Cpf1 can be Harnessed to Facilitate Genome Editing in Human Cells Cpf1-family proteins were codon optimized and attached a C-terminal nuclear localization signal (NLS) for optimal expression and nuclear targeting in human cells (FIG. 64A). To test the activity of each Cpf1-family protein, a guide RNA target site was selected within the DNMT1 gene (FIG. 64B). Each of the Cpf1-family proteins along with its respective crRNA designed to target DNMT1 was able to cleave a PCR amplicon of the DNMT1 genomic region in vitro (FIG. 64C). When tested in human embryonic kidney 293FT (HEK 293FT) cells, 2 of the Cpf1-family proteins (7—AsCpf1 and 13—LbCpf1) exhibited detectable levels of nuclease-induced indels under the conditions employed (FIGS. 64C and D).

Each Cpf1-family protein was tested with additional genomic targets. AsCpf1 and LbCpf1 consistently mediated robust genome editing in HEK293FT cells (FIGS. 64E and 71). When compared to Cas9, AsCpf1 and LbCpf1 mediated comparable levels of indel formation (FIG. 64E). Additionally, we used in vitro cleavage followed by Sanger sequencing of the cleaved DNA ends and found that 7—AsCpf1 and 13—LbCpf1 also generated staggered cleavage sites (FIGS. 64D and 70E).

Following are nucleotide and amino acid sequences of FnCpf1 constructs and orthologs

```
FnCpft locus sequences
pFnCpft
5'end of endogenous F. novicida acetyltranferase (up-
stream of FnCpf1 locus)
FnCpf1
Cas4

Cas1

Cas2
Direct repeats
Spacer
                                                     (SEQ ID NO:  211)
CATCAAGGAATTGGTTCTAAGCTTATAGAAGCAATGATTAAGGAAGCCAAAAAAAATAATAT

TGATGCAATATTTGTCTTAGGTCATCCAAGTTATTATCCAAAATTTGGTTTTAAACCAGCCAC

AGAATATCAGATAAAATGTGAATATGATGTCCCAGCGGATGTTTTTATGGTACTAGATTTGT

CAGCTAAACTAGCTAGTTTAAAAGGACAAACTGTCTACTATGCCGATGAGTTTGGCAAAATT

TTTTAGATCTACAAAATTATAAACTAAATAAAGATTCTTATAATAACTTTATATATAA

TCGAAATGTAGAGAATTTTATAAGGAGTCTTTATCATGTCAATTTATCAAGAATTTG
```

```
TTAATAAATATAGTTTAAGTAAAACTCTAAGATTTGAGTTAATCCCACAGGGTAAAA

CACTTGAAAACATAAAAGCAAGAGGTTTGATTTTAGATGATGAGAAAAGAGCTAAA

GACTACAAAAAGGCTAAACAAATAATTGATAAATATCATCAGTTTTTTATAGAGGA

GATATTAAGTTCGGTTTGTATTAGCGAAGATTTATTACAAAACTATTCTGATGTTTAT

TTTAAACTTAAAAAGAGTGATGATGATAATCTACAAAAAGATTTTAAAAGTGCAAA

AGATACGATAAAGAAACAAATATCTGAATATATAAAGGACTCAGAGAAATTTAAGA

ATTTGTTTAATCAAAACCTTATCGATGCTAAAAAAGGGCAAGAGTCAGATTTAATTC

TATGGCTAAAGCAATCTAAGGATAATGGTATAGAACTATTTAAAGCCAATAGTGAT

ATCACAGATATAGATGAGGCGTTAGAAATAATCAAATCTTTTAAAGGTTGGACAACT

TATTTTAAGGGTTTTCATGAAAATAGAAAAAATGTTTATAGTAGCAATGATATTCCT

ACATCTATTATTTATAGGATAGTAGATGATAATTTGCCTAAATTTCTAGAAAATAAA

GCTAAGTATGAGAGTTTAAAAGACAAAGCTCCAGAAGCTATAAACTATGAACAAAT

TAAAAAGATTTGGCAGAAGAGCTAACCTTTGATATTGACTACAAAACATCTGAAG

TTAATCAAGAGTTTTTTCACTTGATGAAGTTTTTGAGATAGCAAACTTTAATAATTA

TCTAAATCAAAGTGGTATTACTAAATTTAATACTATTATTGGTGGTAAATTTGTAAAT

GGTGAAAATACAAAGAGAAAAGGTATAAATGAATATATAAATCTATACTCACAGCA

AATAAATGATAAAACACTCAAAAAATATAAAATGAGTGTTTTATTTAAGCAAATTTT

AAGTGATACAGAATCTAAATCTTTTGTAATTGATAAGTTAGAAGATGATAGTGATGT

AGTTACAACGATGCAAAGTTTTTATGAGCAAATAGCAGCTTTTAAAACAGTAGAAG

AAAAATCTATTAAAGAAACACTATCTTTATTATTTGATGATTTAAAAGCTCAAAAAC

TTGATTTGAGTAAAATTTATTTTAAAAATGATAAATCTCTTACTGATCTATCACAACA

AGTTTTTGATGATTATAGTGTTATTGGTACAGCGGTACTAGAATATATAACTCAACA

AATAGCACCTAAAAATCTTGATAACCCTAGTAAGAAAGAGCAAGAATTAATAGCCA

AAAAAACTGAAAAAGCAAAATACTTATCTCTAGAAACTATAAAGCTTGCCTTAGAA

GAATTTAATAAGCATAGAGATATAGATAAACAGTGTAGGTTTGAAGAAATACTTGC

AAACTTTGCGGCTATTCCGATGATATTTGATGAAATAGCTCAAAACAAAGACAATTT

GGCACAGATATCTATCAAATATCAAAATCAAGGTAAAAAAGACCTACTTCAAGCTA

GTGCGGAAGATGATGTTAAAGCTATCAAGGATCTTTTAGATCAAACTAATAATCTCT

TACATAAACTAAAAATATTTCATATTAGTCAGTCAGAAGATAAGGCAAATATTTTAG

ACAAGGATGAGCATTTTTATCTAGTATTTGAGGAGTGCTACTTTGAGCTAGCGAATA

TAGTGCCTCTTTATAACAAAATTAGAAACTATATAACTCAAAAGCCATATAGTGATG

AGAAATTTAAGCTCAATTTTGAGAACTCGACTTTGGCTAATGGTTGGGATAAAAATA

AAGAGCCTGACAATACGGCAATTTTATTTATCAAAGATGATAAATATTATCTGGGTG

TGATGAATAAGAAAATAACAAATATTTGATGATAAAGCTATCAAAGAAAATAAA

GGCGAGGGTTATAAAAAAATTGTTTATAAACTTTTACCTGGCGCAAATAAAATGTTA

CCTAAGGTTTTCTTTTCTGCTAAATCTATAAAATTTTATAATCCTAGTGAAGATATAC

TTAGAATAAGAAATCATTCCACACATACAAAAAATGGTAGTCCTCAAAAAGGATAT

GAAAAATTTGAGTTTAATATTGAAGATTGCCGAAAATTTATAGATTTTTATAAACAG

TCTATAAGTAAGCATCCGGAGTGGAAAGATTTTGGATTTAGATTTTCTGATACTCAA

AGATATAATTCTATAGATGAATTTTATAGAGAAGTTGAAAATCAAGGCTACAAACTA
```

-continued

ACTTTTGAAAATATATCAGAGAGCTATATTGATAGCGTAGTTAATCAGGGTAAATTG

TACCTATTCCAAATCTATAATAAAGATTTTTCAGCTTATAGCAAAGGGCGACCAAAT

CTACATACTTTATATTGGAAAGCGCTGTTTGATGAGAGAAATCTTCAAGATGTGGTT

TATAAGCTAAATGGTGAGGCAGAGCTTTTTTATCGTAAACAATCAATACCTAAAAAA

ATCACTCACCCAGCTAAAGAGGCAATAGCTAATAAAAACAAAGATAATCCTAAAAA

AGAGAGTGTTTTTGAATATGATTTAATCAAAGATAAACGCTTTACTGAAGATAAGTT

TTTCTTTCACTGTCCTATTACAATCAATTTTAAATCTAGTGGAGCTAATAAGTTTAAT

GATGAAATCAATTTATTGCTAAAAGAAAAAGCAAATGATGTTCATATATTAAGTATA

GATAGAGGTGAAAGACATTTAGCTTACTATACTTTGGTAGATGGTAAAGGCAATATC

ATCAAACAAGATACTTTCAACATCATTGGTAATGATAGAATGAAAACAAACTACCA

TGATAAGCTTGCTGCAATAGAGAAAGATAGGGATTCAGCTAGGAAAGACTGGAAAA

AGATAAATAACATCAAAGAGATGAAAGAGGGCTATCTATCTCAGGTAGTTCATGAA

ATAGCTAAGCTAGTTATAGAGTATAATGCTATTGTGGTTTTTGAGGATTTAAATTTTG

GATTTAAAAGAGGGCGTTTCAAGGTAGAGAAGCAGGTCTATCAAAAGTTAGAAAAA

ATGCTAATTGAGAAACTAAACTATCTAGTTTTCAAAGATAATGAGTTTGATAAAACT

GGGGGAGTGCTTAGAGCTTATCAGCTAACAGCACCTTTTGAGACTTTTAAAAAGATG

GGTAAACAAACAGGTATTATCTACTATGTACCAGCTGGTTTTACTTCAAAAATTTGT

CCTGTAACTGGTTTTGTAAATCAGTTATATCCTAAGTATGAAAGTGTCAGCAAATCT

CAAGAGTTCTTTAGTAAGTTTGACAAGATTTGTTATAACCTTGATAAGGGCTATTTTG

AGTTTAGTTTTGATTATAAAAACTTTGGTGACAAGGCTGCCAAAGGCAAGTGGACTA

TAGCTAGCTTTGGGAGTAGATTGATTAACTTTAGAAATTCAGATAAAAATCATAATT

GGGATACTCGAGAAGTTTATCCAACTAAAGAGTTGGAGAAATTGCTAAAAGATTAT

TCTATCGAATATGGGCATGGCGAATGTATCAAAGCAGCTATTTGCGGTGAGAGCGA

CAAAAAGTTTTTTGCTAAGCTAACTAGTGTCCTAAATACTATCTTACAAATGCGTAA

CTCAAAAACAGGTACTGAGTTAGATTATCTAATTTCACCAGTAGCAGATGTAAATGG

CAATTTCTTTGATTCGCGACAGGCGCCAAAAAATATGCCTCAAGATGCTGATGCCAA

TGGTGCTTATCATATTGGGCTAAAAGGTCTGATGCTACTAGGTAGGATCAAAAATAA

TCAAGAGGGCAAAAAACTCAATTTGGTTATCAAAAATGAAGAGTATTTTGAGTTCGT

GCAGAATAGGAATAACTAATTCATTCAAGAATATATTACCCTGTCAGTTTAGCGACT

ATTACCTCTTTAATAATTTGCAGGGGAATTATTTTAGTAATAGTAATATACACAAGA

GTTATTGATTATATGGAAAATTATATTTAGATAACATGGTTAAATGATTTTATATTCT

GTCCTTACTCGATATATTTGCATAATATCTATAGTAATGCCTCAGATACTACATACTA

TTCATCTAGCCAAACAAAAGGGCGCGATGCTCATAAAAGTATCGATAAAGGAATCT

ATAGTACCAAAAAAGATGACCTGATCGGTATCGATGTTATTAACCATAAATATGGTT

TGGTTGGTAAAATTGATGTTTTTCATAAAGATAAGGGCTTACTTGTGGAGAGAAAA

GGCAAATCAAGACTATCTATGATGGCTATAAATATCAGCTTTATGCGCAATATTTT

GTCTCCAAGAGATGGGCTATGATGTCAAAGCCATTAAATTTTATTCGATGGTTGATA

-continued

<u>ATAAATCATACCCAATAGCTATACCAACTTCAGCTGAGTTAGAAAAGTTTGAAAAAC</u>

<u>ATATTCAAACAATCAAGCAATATAATCCAATGGATAACTCATTTAGGCAAAATATTG</u>

<u>AAAAGTGTAAATTTTGTATATATGCAAACTTATGTGATAAAACGGACTTGTAGATTA</u>

TGTTTAGTAAAAATGATATTGAATCAAAGAATATAGTTTTTGTTAATATTTTTGATGG

AGTGAAACTTAGTCTATCATTGGGGAATATAGTTATAAAAGATAAAGAAACTGATG

AGGTGAAAACTAAGCTTTCTGTTCATAAAGTTCTTGCATTGTTTATCGTAGGTAATAT

GACGATGACCTCGCAACTTTTAGAGACCTGTAAGAAAAATGCTATACAGCTAGTTTT

TATGAAAAATAGCTTTAGACCATATCTATGTTTTGGTGATATTGCTGAGGCTAATTTT

TTAGCTAGATATAAGCAATATAGTGTAGTTGAGCAAGATATAAGTTTAGCAAGGATT

TTTATAACATCAAAGATACGCAATCAACATAACTTAGTCAAAAGCCTAAGAGATAA

AACTCCAGAGCAGCAAGAGATAGTCAAAAAGAATAAACAGCTAATAGCAGAGTTA

GAAAATACAACAAGCCTAGCGGAGCTAATGGGTATAGAGGGCAATGTTGCCAAAAA

TTTCTTCAAAGGATTCTATGGACATTTAGATAGTTGGCAAGGGCGCAAACCTAGAAT

AAAACAGGATCCATATAATGTTGTTTTAGACTTGGGCTATAGTATGTTGTTTAATTTT

GTAGAGTGTTTTTTGCGACTTTTTGGCTTTGATTTATACAAGGGCTTTTGTCATCAGA

CTTGGTATAAGCGTAAATCCCTAGTTTGTGACTTTGTTGAGCCATTTAGATGTATAGT

GGATAACCAAGTTAGAAAATCATGGAATCTCGGGCAATTTTCTGTAGAGGATTTTGG

TTGCAAAAATGAGCAGTTTTATATAAAAAAAGATAAAACAAAAGACTACTCAAAAA

TACTTTTTGCCGAGATTATCAGCTACAAGCTAGAGATATTTGAATATGTAAGAGAAT

TTTATCGTGCCTTTATGCGAGGCAAAGAAATTGCAGAGTATCCAATATTTTGTTATG

AAACTAGGAGGGTGTATGTTGATAGTCAGTTATGATTTTAGTAATAATAAAGTACGT

GCAAAGTTTGCCAAATTTCTAGAAAGTTATGGTGTACGTTTACAATATTCGGTATTT

GAGCTCAAATATAGCAAGAGAATGTTAGACTTGATTTTAGCTGAGATAGAAAATAA

CTATGTACCACTATTTACAAATGCTGATAGTGTTTTAATCTTTAATGCTCCAGATAAA

GATGTGATAAAATATGGTTATGCGATTCATAGAGAACAAGAGGTTGTTTTTATAGAC

TAAAAATTGCAAACCTTAGTCTTTATGTTAAAATAACTACTAAGTTCTTAGAGATAT

TTAAAAATATGACTGTTGTTATATATCAAAATGCTAAAAAAATCATAGATTTTAGGT

CTTTTTTTGCTGATTTAGGCAAAAACGGGTCTAAGAACTTTAAATAATTTCTACTG

TTGTAGATGAGAAGTCATTTAATAAGGCCACTGTTAAAAGTCTAAGAACTTTAAA

TAATTTCTACTGTTGTAGATGCTACTATTCCTGTGCCTTCAGATAATTCAGTCTAA

GAACTTTAAATAATTTCTACTGTTGTAGATGTCTAGAGCCTTTTGTATTAGTAGCC

GGTCTAAGAACTTTAAATAATTTCTACTGTTGTAGATTAGCGATTTATGAAGGTC

ATTTTTTTGTCT
pFnCpf1_min
<u>Lac promoter</u>
*Shine-Dalgarno sequence*
<u>FnCpf1</u>
<u>J23119 promoter</u>
Direct repeats
<u>Spacer</u>

(SEQ ID NO: 212)

<u>TTTACACTTTATGCTTCCGGCTCGTATGTT</u>*AGGAGG*TCTTTATCATGTCAATTTATCAAGAATT

TGTTAATAAATATAGTTTAAGTAAAACTCTAAGATTTGAGTTAATCCCACAGGGTAAAACAC

-continued

```
TTGAAAACATAAAAGCAAGAGGTTTGATTTTAGATGATGAGAAAAGAGCTAAAGACTACAA

AAAGGCTAAACAAATAATTGATAAATATCATCAGTTTTTTATAGAGGAGATATTAAGTTCGG

TTTGTATTAGCGAAGATTTATTACAAAACTATTCTGATGTTTATTTTAAACTTAAAAAGAGTG

ATGATGATAATCTACAAAAAGATTTTAAAAGTGCAAAAGATACGATAAAGAAACAAATATC

TGAATATATAAAGGACTCAGAGAAATTTAAGAATTTGTTTAATCAAAACCTTATCGATGCTA

AAAAAGGGCAAGAGTCAGATTTAATTCTATGGCTAAAGCAATCTAAGGATAATGGTATAGA

ACTATTTAAAGCCAATAGTGATATCACAGATATAGATGAGGCGTTAGAAATAATCAAATCTT

TTAAAGGTTGGACAACTTATTTTAAGGGTTTTCATGAAAATAGAAAAAATGTTTATAGTAGC

AATGATATTCCTACATCTATTATTTATAGGATAGTAGATGATAATTTGCCTAAATTTCTAGAA

AATAAAGCTAAGTATGAGAGTTTAAAAGACAAAGCTCCAGAAGCTATAAACTATGAACAAA

TTAAAAAGATTTGGCAGAAGAGCTAACCTTTGATATTGACTACAAAACATCTGAAGTTAAT

CAAAGAGTTTTTTCACTTGATGAAGTTTTTGAGATAGCAAACTTTAATAATTATCTAAATCAA

AGTGGTATTACTAAATTTAATACTATTATTGGTGGTAAATTTGTAAATGGTGAAAATACAAA

GAGAAAAGGTATAAATGAATATATAAATCTATACTCACAGCAAATAAATGATAAAACACTC

AAAAAATATAAAATGAGTGTTTTATTTAAGCAAATTTTAAGTGATACAGAATCTAAATCTTT

TGTAATTGATAAGTTAGAAGATGATAGTGATGTAGTTACAACGATGCAAAGTTTTTATGAGC

AAATAGCAGCTTTTAAAACAGTAGAAGAAAAATCTATTAAAGAAACACTATCTTTATTATTT

GATGATTTAAAAGCTCAAAAACTTGATTTGAGTAAAATTTATTTTAAAAATGATAAATCTCT

TACTGATCTATCACAACAAGTTTTTGATGATTATAGTGTTATTGGTACAGCGGTACTAGAATA

TATAACTCAACAAATAGCACCTAAAAATCTTGATAACCCTAGTAAGAAAGAGCAAGAATTA

ATAGCCAAAAAAACTGAAAAAGCAAAATACTTATCTCTAGAAACTATAAAGCTTGCCTTAG

AAGAATTTAATAAGCATAGAGATATAGATAAACAGTGTAGGTTTGAAGAAATACTTGCAAA

CTTTGCGGCTATTCCGATGATATTTGATGAAATAGCTCAAAACAAAGACAATTTGGCACAGA

TATCTATCAAATATCAAAATCAAGGTAAAAAAGACCTACTTCAAGCTAGTGCGGAAGATGA

TGTTAAAGCTATCAAGGATCTTTTAGATCAAACTAATAATCTCTTACATAAACTAAAAATAT

TTCATATTAGTCAGTCAGAAGATAAGGCAAATATTTTAGACAAGGATGAGCATTTTTATCTA

GTATTTGAGGAGTGCTACTTTGAGCTAGCGAATATAGTGCCTCTTTATAACAAAATTAGAAA

CTATATAACTCAAAAGCCATATAGTGATGAGAAATTTAAGCTCAATTTTGAGAACTCGACTT

TGGCTAATGGTTGGGATAAAAATAAAGAGCCTGACAATACGGCAATTTTATTTATCAAAGAT

GATAAATATTATCTGGGTGTGATGAATAAGAAAAATAACAAAATATTTGATGATAAAGCTAT

CAAAGAAAATAAAGGCGAGGGTTATAAAAAAATTGTTTATAAACTTTTACCTGGCGCAAAT

AAAATGTTACCTAAGGTTTTCTTTTCTGCTAAATCTATAAAATTTTATAATCCTAGTGAAGAT

ATACTTAGAATAAGAAATCATTCCACACATACAAAAAATGGTAGTCCTCAAAAAGGATATG

AAAAATTTGAGTTTAATATTGAAGATTGCCGAAAATTTATAGATTTTTATAAACAGTCTATA

AGTAAGCATCCGGAGTGGAAAGATTTTGGATTTAGATTTTCTGATACTCAAAGATATAATTC

TATAGATGAATTTTATAGAGAAGTTGAAAATCAAGGCTACAAACTAACTTTTGAAAATATAT

CAGAGAGCTATATTGATAGCGTAGTTAATCAGGGTAAATTGTACCTATTCCAAATCTATAAT

AAAGATTTTTCAGCTTATAGCAAAGGGCGACCAAATCTACATACTTTATATTGGAAAGCGCT

GTTTGATGAGAGAAATCTTCAAGATGTGGTTTATAAGCTAAATGGTGAGGCAGAGCTTTTTT

ATCGTAAACAATCAATACCTAAAAAAATCACTCACCCAGCTAAAGAGGCAATAGCTAATAA
```

```
                                          -continued
AAACAAAGATAATCCTAAAAAAGAGAGTGTTTTTGAATATGATTTAATCAAAGATAAACGC

TTTACTGAAGATAAGTTTTTCTTTCACTGTCCTATTACAATCAATTTTAAATCTAGTGGAGCT

AATAAGTTTAATGATGAAATCAATTTATTGCTAAAAGAAAAAGCAAATGATGTTCATATATT

AAGTATAGATAGAGGTGAAAGACATTTAGCTTACTATACTTTGGTAGATGGTAAAGGCAATA

TCATCAAACAAGATACTTTCAACATCATTGGTAATGATAGAATGAAAACAAACTACCATGAT

AAGCTTGCTGCAATAGAGAAAGATAGGGATTCAGCTAGGAAAGACTGGAAAAAGATAAATA

ACATCAAAGAGATGAAAGAGGGCTATCTATCTCAGGTAGTTCATGAAATAGCTAAGCTAGTT

ATAGAGTATAATGCTATTGTGGTTTTTGAGGATTTAAATTTTGGATTTAAAAGAGGGCGTTTC

AAGGTAGAGAAGCAGGTCTATCAAAAGTTAGAAAAAATGCTAATTGAGAAACTAAACTATC

TAGTTTTCAAAGATAATGAGTTTGATAAAACTGGGGGAGTGCTTAGAGCTTATCAGCTAACA

GCACCTTTTGAGACTTTTAAAAAGATGGGTAAACAAACAGGTATTATCTACTATGTACCAGC

TGGTTTTACTTCAAAAATTTGTCCTGTAACTGGTTTTGTAAATCAGTTATATCCTAAGTATGA

AAGTGTCAGCAAATCTCAAGAGTTCTTTAGTAAGTTTGACAAGATTTGTTATAACCTTGATA

AGGGCTATTTTGAGTTTAGTTTTGATTATAAAAACTTTGGTGACAAGGCTGCCAAAGGCAAG

TGGACTATAGCTAGCTTTGGGAGTAGATTGATTAACTTTAGAAATTCAGATAAAAATCATAA

TTGGGATACTCGAGAAGTTTATCCAACTAAAGAGTTGGAGAAATTGCTAAAAGATTATTCTA

TCGAATATGGGCATGGCGAATGTATCAAAGCAGCTATTTGCGGTGAGAGCGACAAAAAGTT

TTTTGCTAAGCTAACTAGTGTCCTAAATACTATCTTACAAATGCGTAACTCAAAAACAGGTA

CTGAGTTAGATTATCTAATTTCACCAGTAGCAGATGTAAATGGCAATTTCTTTGATTCGCGAC

AGGCGCCAAAAAATATGCCTCAAGATGCTGATGCCAATGGTGCTTATCATATTGGGCTAAAA

GGTCTGATGCTACTAGGTAGGATCAAAAATAATCAAGAGGGCAAAAAACTCAATTTGGTTA

TCAAAAATGAAGAGTATTTTGAGTTCGTGCAGAATAGGAATAACTAATTGACAGCTAGCTCA

GTCCTAGGTATAATGCTAGCGCTGATTTAGGCAAAAACGGGTCTAAGAACTTTAAATAATT

GTCCTAGGTATAATGCTAGCGCTGATTTAGGCAAAAACGGGTCTAAGAACTTTAAATAATT

TCTACTGTTGTAGATGAGAAGTCATTTAATAAGGCCACTGTTAAAAGTCTAAGAACTTTA

AATAATTTCTACTGTTGTAGATGCTACTATTCCTGTGCCTTCAGATAATTCAGTCTAAGAA

CTTTAAATAATTTCTACTGTTGTAGA
pFnCpf1_ACas
5'end of endogenous F. novicida acetyltranferase (up-
stream of FnCpf1 locus
FnCpf1
Direct repeats
Spacer
                                                        (SEQ ID NO: 213)
CTGTCTACTATGCCGATGAGTTTGGCAAAATTTTTTAGATCTACAAAATTATAAACTAAATAAAG

ATTCTTATAATAACTTTATATATAATCGAAATGTAGAGAATTTTATAAGGAGTCTTTATCATG

TCAATTTATCAAGAATTTGTTAATAAATATAGTTTAAGTAAAACTCTAAGATTTGAGTTAATC

CCACAGGGTAAAACACTTGAAAACATAAAAGCAAGAGGTTTGATTTTAGATGATGAGAAAA

GAGCTAAAGACTACAAAAAGGCTAAACAAATAATTGATAAATATCATCAGTTTTTTATAGAG

GAGATATTAAGTTCGGTTTGTATTAGCGAAGATTTATTACAAAACTATTCTGATGTTTATTTT

AAACTTAAAAAGAGTGATGATGATAATCTACAAAAAGATTTTAAAGTGCAAAAGATACGA

TAAAGAAACAAATATCTGAATATATAAAGGACTCAGAGAAATTTAAGAATTTGTTTAATCAA

AACCTTATCGATGCTAAAAAAGGGCAAGAGTCAGATTTAATTCTATGGCTAAAGCAATCTAA

GGATAATGGTATAGAACTATTTAAAGCCAATAGTGATATCACAGATATAGATGAGGCGTTA
```

-continued

```
GAAATAATCAAATCTTTTAAAGGTTGGACAACTTATTTTAAGGGTTTTCATGAAAATAGAAA

AAATGTTTATAGTAGCAATGATATTCCTACATCTATTATTTATAGGATAGTAGATGATAATTT

GCCTAAATTTCTAGAAAATAAAGCTAAGTATGAGAGTTTAAAAGACAAAGCTCCAGAAGCT

ATAAACTATGAACAAATTAAAAAAGATTTGGCAGAAGAGCTAACCTTTGATATTGACTACA

AAACATCTGAAGTTAATCAAAGAGTTTTTTCACTTGATGAAGTTTTTGAGATAGCAAACTTT

AATAATTATCTAAATCAAAGTGGTATTACTAAATTTAATACTATTATTGGTGGTAAATTTGTA

AATGGTGAAAATACAAAGAGAAAAGGTATAAATGAATATATAAATCTATACTCACAGCAAA

TAAATGATAAAACACTCAAAAAATATAAAATGAGTGTTTTATTTAAGCAAATTTTAAGTGAT

ACAGAATCTAAATCTTTTGTAATTGATAAGTTAGAAGATGATAGTGATGTAGTTACAACGAT

GCAAAGTTTTTATGAGCAAATAGCAGCTTTTAAAACAGTAGAAGAAAAATCTATTAAAGAA

ACACTATCTTTATTATTTGATGATTTAAAAGCTCAAAAACTTGATTTGAGTAAAATTTATTTT

AAAAATGATAAATCTCTTACTGATCTATCACAACAAGTTTTTGATGATTATAGTGTTATTGGT

ACAGCGGTACTAGAATATATAACTCAACAAATAGCACCTAAAAATCTTGATAACCCTAGTAA

GAAAGAGCAAGAATTAATAGCCAAAAAAACTGAAAAAGCAAAATACTTATCTCTAGAAACT

ATAAAGCTTGCCTTAGAAGAATTTAATAAGCATAGAGATATAGATAAACAGTGTAGGTTTGA

AGAAATACTTGCAAACTTTGCGGCTATTCCGATGATATTTGATGAAATAGCTCAAAACAAAG

ACAATTTGGCACAGATATCTATCAAATATCAAAATCAAGGTAAAAAGACCTACTTCAAGCT

AGTGCGGAAGATGATGTTAAAGCTATCAAGGATCTTTTAGATCAAACTAATAATCTCTTACA

TAAACTAAAAATATTTCATATTAGTCAGTCAGAAGATAAGGCAAATATTTTAGACAAGGATG

AGCATTTTTATCTAGTATTTGAGGAGTGCTACTTTGAGCTAGCGAATATAGTGCCTCTTTATA

ACAAAATTAGAAACTATATAACTCAAAAGCCATATAGTGATGAGAAATTTAAGCTCAATTTT

GAGAACTCGACTTTGGCTAATGGTTGGGATAAAAATAAAGAGCCTGACAATACGGCAATTTT

ATTTATCAAAGATGATAAATATTATCTGGGTGTGATGAATAAGAAAAATAACAAAATATTTG

ATGATAAAGCTATCAAAGAAAATAAAGGCGAGGGTTATAAAAAAATTGTTTATAAACTTTT

ACCTGGCGCAAATAAAATGTTACCTAAGGTTTTCTTTTCTGCTAAATCTATAAAATTTTATAA

TCCTAGTGAAGATATACTTAGAATAAGAAATCATTCCACACATACAAAAAATGGTAGTCCTC

AAAAAGGATATGAAAAATTTGAGTTTAATATTGAAGATTGCCGAAAATTTATAGATTTTTAT

AAACAGTCTATAAGTAAGCATCCGGAGTGGAAAGATTTTGGATTTAGATTTTCTGATACTCA

AAGATATAATTCTATAGATGAATTTTATAGAGAAGTTGAAAATCAAGGCTACAAACTAACTT

TTGAAAATATATCAGAGAGCTATATTGATAGCGTAGTTAATCAGGGTAAATTGTACCTATTC

CAAATCTATAATAAAGATTTTTCAGCTTATAGCAAAGGGCGACCAAATCTACATACTTTATA

TTGGAAAGCGCTGTTTGATGAGAGAAATCTTCAAGATGTGGTTTATAAGCTAAATGGTGAGG

CAGAGCTTTTTTATCGTAAACAATCAATACCTAAAAAAATCACTCACCCAGCTAAAGAGGCA

ATAGCTAATAAAAACAAAGATAATCCTAAAAAAGAGAGTGTTTTTGAATATGATTAATCAA

AGATAAACGCTTTACTGAAGATAAGTTTTTCTTTCACTGTCCTATTACAATCAATTTTAAATC

TAGTGGAGCTAATAAGTTTAATGATGAAATCAATTTATTGCTAAAAGAAAAGCAAATGAT

GTTCATATATTAAGTATAGATAGAGGTGAAAGACATTTAGCTTACTATACTTTGGTAGATGG

TAAAGGCAATATCATCAAACAAGATACTTTCAACATCATTGGTAATGATAGAATGAAAACA

AACTACCATGATAAGCTTGCTGCAATAGAGAAAGATAGGGATTCAGCTAGGAAAGACTGGA

AAAAGATAAATAACATCAAAGAGATGAAAGAGGGCTATCTATCTCAGGTAGTTCATGAAAT
```

-continued

```
AGCTAAGCTAGTTATAGAGTATAATGCTATTGTGGTTTTTGAGGATTTAAATTTTGGATTTAA

AAGAGGGCGTTTCAAGGTAGAGAAGCAGGTCTATCAAAAGTTAGAAAAAATGCTAATTGAG

AAACTAAACTATCTAGTTTTCAAAGATAATGAGTTTGATAAAACTGGGGGAGTGCTTAGAGC

TTATCAGCTAACAGCACCTTTTGAGACTTTTAAAAAGATGGGTAAACAAACAGGTATTATCT

ACTATGTACCAGCTGGTTTTACTTCAAAAATTTGTCCTGTAACTGGTTTTGTAAATCAGTTAT

ATCCTAAGTATGAAAGTGTCAGCAAATCTCAAGAGTTCTTTAGTAAGTTTGACAAGATTTGT

TATAACCTTGATAAGGGCTATTTTGAGTTTAGTTTTGATTATAAAACTTTGGTGACAAGGCT

GCCAAAGGCAAGTGGACTATAGCTAGCTTTGGGAGTAGATTGATTAACTTTAGAAATTCAGA

TAAAAATCATAATTGGGATACTCGAGAAGTTTATCCAACTAAAGAGTTGGAGAAATTGCTAA

AAGATTATTCTATCGAATATGGGCATGGCGAATGTATCAAAGCAGCTATTTGCGGTGAGAGC

GACAAAAGTTTTTTGCTAAGCTAACTAGTGTCCTAAATACTATCTTACAAATGCGTAACTC

AAAAACAGGTACTGAGTTAGATTATCTAATTTCACCAGTAGCAGATGTAAATGGCAATTTCT

TTGATTCGCGACAGGCGCCAAAAAATATGCCTCAAGATGCTGATGCCAATGGTGCTTATCAT

ATTGGGCTAAAAGGTCTGATGCTACTAGGTAGGATCAAAAATAATCAAGAGGGCAAAAAAC

TCAATTTGGTTATCAAAAATGAAGAGTATTTTGAGTTCGTGCAGAATAGGAATAACTAATTC

ATTCAAGAATATATTACCCTGTCAGTTTAGCGACTATTACCTCTTTAATAATTTGCAGGGGAA

TTATTTTAGTAATAGTAATATACACAAGAGTTATTGATTATATGGAAATTATATTTAGATAA

CATGGTTAAATGATTTTATATTCTGTCCTTACTCGATATATTTTTATAGACTAAAAATTGCA

AACCTTAGTCTTTATGTTAAAATAACTACTAAGTTCTTAGAGATATTTAAAAATATGACTGTT

GTTATATATCAAAATGCTAAAAAAATCATAGATTTTAGGTCTTTTTTTGCTGATTTAGGCAAA

AACGGGTCTAAGAACTTTAAATAATTTCTACTGTTGTAGATGAGAAGTCATTTAATAAGG

CCACTGTTAAAAGTCTAAGAACTTTAAATAATTTCTACTGTTGTAGATGCTACTATTCCTG

TGCCTTCAGATAATTCAGTCTAAGAACTTTAAATAATTTCTACTGTTGTAGATGTCTAGAG

CCTTTTGTATTAGTAGCCGGTCTAAGAACTTTAAATAATTTCTACTGTTGTAGATTAGCGA

TTTATGAAGGTCATTTTTTTGTCT
```

Nucleotide sSequences of human codon optimized Cpf1 orthologs
*Nuclear localization signal (NLS)*
Glycine-Serine linker
3x HA tag
1- Francisella tularensis subsp. Novicida U112 (FnCpf1)

(SEQ ID NO: 214)

```
ATGAGCATCTACCAGGAGTTCGTCAACAAGTATTCACTGAGTAAGACACTGCGGTTCGAGCT

GATCCCACAGGGCAAGACACTGGAGAACATCAAGGCCCGAGGCCTGATTCTGGACGATGAG

AAGCGGGCAAAAGACTATAAGAAAGCCAAGCAGATCATTGATAAATACCACCAGTTCTTTA

TCGAGGAAATTCTGAGCTCCGTGTGCATCAGTGAGGATCTGCTGCAGAATTACTCAGACGTG

TACTTCAAGCTGAAGAAGAGCGACGATGACAACCTGCAGAAGGACTTCAAGTCCGCCAAGG

ACACCATCAAGAAACAGATTAGCGAGTACATCAAGGACTCCGAAAAGTTTAAAAATCTGTT

CAACCAGAATCTGATCGATGCTAAGAAAGGCCAGGAGTCCGACCTGATCCTGTGGCTGAAA

CAGTCTAAGGACAATGGGATTGAACTGTTCAAGGCTAACTCCGATATCACTGATATTGACGA

GGCACTGGAAATCATCAAGAGCTTCAAGGGATGGACCACATACTTTAAAGGCTTCCACGAG

AACCGCAAGAACGTGTACTCCAGCAACGACATTCCTACCTCCATCATCTACCGAATCGTCGA

TGACAATCTGCCAAAGTTCCTGGAGAACAAGGCCAAATATGAATCTCTGAAGGACAAAGCT

CCCGAGGCAATTAATTACGAACAGATCAAGAAAGATCTGGCTGAGGAACTGACATTCGATA

TCGACTATAAGACTAGCGAGGTGAACCAGAGGGTCTTTTCCCTGGACGAGGTGTTTGAAATC
```

-continued

```
GCCAATTTCAACAATTACCTGAACCAGTCCGGCATTACTAAATTCAATACCATCATTGGCGG

GAAGTTTGTGAACGGGGAGAATACCAAGCGCAAGGGAATTAACGAATACATCAATCTGTAT

AGCCAGCAGATCAACGACAAAACTCTGAAGAAATACAAGATGTCTGTGCTGTTCAAACAGA

TCCTGAGTGATACCGAGTCCAAGTCTTTTGTCATTGATAAACTGGAAGATGACTCAGACGTG

GTCACTACCATGCAGAGCTTTTATGAGCAGATCGCCGCTTTCAAGACAGTGGAGGAAAAATC

TATTAAGGAAACTCTGAGTCTGCTGTTCGATGACCTGAAAGCCCAGAAGCTGGACCTGAGTA

AGATCTACTTCAAAAACGATAAGAGTCTGACAGACCTGTCACAGCAGGTGTTTGATGACTAT

TCCGTGATTGGGACCGCCGTCCTGGAGTACATTACACAGCAGATCGCTCCAAAGAACCTGGA

TAATCCCTCTAAGAAAGAGCAGGAACTGATCGCTAAGAAAACCGAGAAGGCAAAATATCTG

AGTCTGGAAACAATTAAGCTGGCACTGGAGGAGTTCAACAAGCACAGGGATATTGACAAAC

AGTGCCGCTTTGAGGAAATCCTGGCCAACTTCGCAGCCATCCCCATGATTTTTGATGAGATC

GCCCAGAACAAAGACAATCTGGCTCAGATCAGTATTAAGTACCAGAACCAGGGCAAGAAAG

ACCTGCTGCAGGCTTCAGCAGAAGATGACGTGAAAGCCATCAAGGATCTGCTGGACCAGAC

CAACAATCTGCTGCACAAGCTGAAAATCTTCCATATTAGTCAGTCAGAGGATAAGGCTAATA

TCCTGGATAAAGACGAACACTTCTACCTGGTGTTCGAGGAATGTTACTTCGAGCTGGCAAAC

ATTGTCCCCCTGTATAACAAGATTAGGAACTACATCACACAGAAGCCTTACTCTGACGAGAA

GTTTAAACTGAACTTCGAAAATAGTACCCTGGCCAACGGGTGGGATAAGAACAAGGAGCCT

GACAACACAGCTATCCTGTTCATCAAGGATGACAAGTACTATCTGGGAGTGATGAATAAGA

AAAACAATAAGATCTTCGATGACAAAGCCATTAAGGAGAACAAAGGGGAAGGATACAAGA

AAATCGTGTATAAGCTGCTGCCCGGCGCAAATAAGATGCTGCCTAAGGTGTTCTTCAGCGCC

AAGAGTATCAAATTCTACAACCCATCCGAGGACATCCTGCGGATTAGAAATCACTCAACACA

TACTAAGAACGGGAGCCCCAGAAGGGATATGAGAAATTTGAGTTCAACATCGAGGATTGC

AGGAAGTTTATTGACTTCTACAAGCAGAGCATCTCCAAACACCCTGAATGGAAGGATTTTGG

CTTCCGGTTTTCCGACACACAGAGATATAACTCTATCGACGAGTTCTACCGCGAGGTGGAAA

ATCAGGGGTATAAGCTGACTTTTGAGAACATTTCTGAAAGTTACATCGACAGCGTGGTCAAT

CAGGGAAAGCTGTACCTGTTCCAGATCTATAACAAAGATTTTTCAGCATACAGCAAGGGCAG

ACCAAACCTGCATACACTGTACTGGAAGGCCCTGTTCGATGAGAGGAATCTGCAGGACGTG

GTCTATAAACTGAACGGAGAGGCCGAACTGTTTTACCGGAAGCAGTCTATTCCTAAGAAAAT

CACTCACCCAGCTAAGGAGGCCATCGCTAACAAGAACAAGGACAATCCTAAGAAAGAGAGC

GTGTTCGAATACGATCTGATTAAGGACAAGCGGTTCACCGAAGATAAGTTCTTTTTCCATTG

TCCAATCACCATTAACTTCAAGTCAAGCGGCGCTAACAAGTTCAACGACGAGATCAATCTGC

TGCTGAAGGAAAAAGCAAACGATGTGCACATCCTGAGCATTGACCGAGGAGAGCGGCATCT

GGCCTACTATCCCTGGTGGATGGCAAAGGGAATATCATTAAGCAGGATACATTCAACATCA

TTGGCAATGACCGGATGAAAACCAACTACCACGATAAACTGGCTGCAATCGAGAAGGATAG

AGACTCAGCTAGGAAGGACTGGAAGAAAATCAACAACATTAAGGAGATGAAGGAAGGCTA

TCTGAGCCAGGTGGTCCATGAGATTGCAAAGCTGGTCATCGAATACAATGCCATTGTGGTGT

TCGAGGATCTGAACTTCGGCTTTAAGAGGGGCGCTTTAAGGTGGAAAAACAGGTCTATCA

GAAGCTGGAGAAAATGCTGATCGAAAAGCTGAATTACCTGGTGTTTAAAGATAACGAGTTC

GACAAGACCGGAGGCGTCCTGAGAGCCTACCAGCTGACAGCTCCCTTTGAAACTTTCAAGA

AAATGGGAAAACAGACAGGCATCATCTACTATGTGCCAGCCGGATTCACTTCCAAGATCTGC

CCCGTGACCGGCTTTGTCAACCAGCTGTACCCTAAATATGAGTCAGTGAGCAAGTCCCAGGA
```

-continued

ATTTTTCAGCAAGTTCGATAAGATCTGTTATAATCTGGACAAGGGGTACTTCGAGTTTTCCTT
CGATTACAAGAACTTCGGCGACAAGGCCGCTAAGGGGAAATGGACCATTGCCTCCTTCGGA
TCTCGCCTGATCAACTTTCGAAATTCCGATAAAAACCACAATTGGGACACTAGGGAGGTGTA
CCCAACCAAGGAGCTGGAAAAGCTGCTGAAAGACTACTCTATCGAGTATGGACATGGCGAA
TGCATCAAGGCAGCCATCTGTGGCGAGAGTGATAAGAAATTTTTCGCCAAGCTGACCTCAGT
GCTGAATACAATCCTGCAGATGCGGAACTCAAAGACCGGGACAGAACTGGACTATCTGATT
AGCCCCGTGGCTGATGTCAACGGAAACTTCTTCGACAGCAGACAGGCACCCAAAAATATGC
CTCAGGATGCAGACGCCAACGGGGCCTACCACATCGGGCTGAAGGGACTGATGCTGCTGGG
CCGGATCAAGAACAATCAGGAGGGGAAGAAGCTGAACCTGGTCATTAAGAACGAGGAATA
CTTCGAGTTTGTCCAGAATAGAAATAAC**AAAAGGCCGGCGGCCACGAAAAAGGCCGGCCAGGC
AAAAAAGAAAAAGG<u>GGATCC</u>TACCCATACGATGTTCCAGATTACGCTTATCCCTACGACGTG
CCTGATTATGCATACCCATATGATGTCCCCGACTATGCC**

3- Lachnospiraceae bacterium MC2017 (Lb3Cpf1)

(SEQ ID NO: 215)

ATGGATTACGGCAACGGCCAGTTTGAGCGGAGAGCCCCCCTGACCAAGACAATCACCCTGC
GCCTGAAGCCTATCGGCGAGACACGGGAGACAATCCGCGAGCAGAAGCTGCTGGAGCAGGA
CGCCGCCTTCAGAAAGCTGGTGGAGACAGTGACCCCTATCGTGGACGATTGTATCAGGAAG
ATCGCCGATAACGCCCTGTGCCACTTTGGCACCGAGTATGACTTCAGCTGTCTGGGCAACGC
CATCTCTAAGAATGACAGCAAGGCCATCAAGAAGGAGACAGAGAAGGTGGAGAAGCTGCT
GGCCAAGGTGCTGACCGAGAATCTGCCAGATGGCCTGCGCAAGGTGAACGACATCAATTCC
GCCGCCTTTATCCAGGATACACTGACCTCTTTCGTGCAGGACGATGCCGACAAGCGGGTGCT
GATCCAGGAGCTGAAGGGCAAGACCGTGCTGATGCAGCGGTTCCTGACCACACGGATCACA
GCCCTGACCGTGTGGCTGCCCGACAGAGTGTTCGAGAACTTTAATATCTTCATCGAGAACGC
CGAGAAGATGAGAATCCTGCTGGACTCCCCTCTGAATGAGAAGATCATGAAGTTTGACCCA
GATGCCGAGCAGTACGCCCTCTCTGGAGTTCTATGGCCAGTGCCTGTCTCAGAAGGACATCGA
TAGCTACAACCTGATCATCTCCGGCATCTATGCCGACGATGAGGTGAAGAACCCTGGCATCA
ATGAGATCGTGAAGGAGTACAATCAGCAGATCCGGGGCGACAAGGATGAGTCCCCACTGCC
CAAGCTGAAGAAGCTGCACAAGCAGATCCTGATGCCAGTGGAGAAGGCCTTCTTTGTGCGC
GTGCTGTCTAACGACAGCGATGCCCGGAGCATCCTGGAGAAGATCCTGAAGGACACAGAGA
TGCTGCCCTCCAAGATCATCGAGGCCATGAAGGAGGCAGATGCAGGCGACATCGCCGTGTA
CGGCAGCCGGCTGCACGAGCTGAGCCACGTGATCTACGGCGATCACGGCAAGCTGTCCCAG
ATCATCTATGACAAGGAGTCCAAGAGGATCTCTGAGCTGATGGAGACACTGTCTCCAAAGG
AGCGCAAGGAGAGCAAGAAGCGGCTGGAGGGCCTGGAGGAGCACATCAGAAAGTCTACAT
ACACCTTCGACGAGCTGAACAGGTATGCCGAGAAGAATGTGATGGCAGCATACATCGCAGC
AGTGGAGGAGTCTTGTGCCGAGATCATGAGAAAGGAGAAGGATCTGAGGACCCTGCTGAGC
AAGGAGGACGTGAAGATCCGGGGCAACAGACACAATACACTGATCGTGAAGAACTACTTTA
ATGCCTGGACCGTGTTCCGGAACCTGATCAGAATCCTGAGGCGCAAGTCCGAGGCCGAGAT
CGACTCTGACTTCTACGATGTGCTGGACGATTCCGTGGAGGTGCTGTCTCTGACATACAAGG
GCGAGAATCTGTGCCGCAGCTATATCACCAAGAAGATCGGCTCCGACCTGAAGCCCGAGAT
CGCCACATACGGCAGCGCCCTGAGGCCTAACAGCCGCTGGTGGTCCCCAGGAGAGAAGTTT
AATGTGAAGTTCCACACCATCGTGCGGAGAGATGGCCGGCTGTACTATTTCATCCTGCCCAA
GGGCGCCAAGCCTGTGGAGCTGGAGGACATGGATGGCGACATCGAGTGTCTGCAGATGAGA

-continued

```
AAGATCCCTAACCCAACAATCTTTCTGCCCAAGCTGGTGTTCAAGGACCCTGAGGCCTTCTTT

AGGGATAATCCAGAGGCCGACGAGTTCGTGTTTCTGAGCGGCATGAAGGCCCCCGTGACAA

TCACCAGAGAGACATACGAGGCCTACAGGTATAAGCTGTATACCGTGGGCAAGCTGCGCGA

TGGCGAGGTGTCCGAAGAGGAGTACAAGCGGGCCCTGCTGCAGGTGCTGACCGCCTACAAG

GAGTTTCTGGAGAACAGAATGATCTATGCCGACCTGAATTTCGGCTTTAAGGATCTGGAGGA

GTATAAGGACAGCTCCGAGTTTATCAAGCAGGTGGAGACACACAACACCTTCATGTGCTGG

GCCAAGGTGTCTAGCTCCCAGCTGGACGATCTGGTGAAGTCTGGCAACGGCCTGCTGTTCGA

GATCTGGAGCGAGCGCCTGGAGTCCTACTATAAGTACGGCAATGAGAAGGTGCTGCGGGGC

TATGAGGGCGTGCTGCTGAGCATCCTGAAGGATGAGAACCTGGTGTCCATGCGGACCCTGCT

GAACAGCCGGCCCATGCTGGTGTACCGGCCAAAGGAGTCTAGCAAGCCTATGGTGGTGCAC

CGGGATGGCAGCAGAGTGGTGGACAGGTTTGATAAGGACGGCAAGTACATCCCCCCTGAGG

TGCACGACGAGCTGTATCGCTTCTTTAACAATCTGCTGATCAAGGAGAAGCTGGGCGAGAAG

GCCCGGAAGATCCTGGACAACAAGAAGGTGAAGGTGAAGGTGCTGGAGAGCGAGAGAGTG

AAGTGGTCCAAGTTCTACGATGAGCAGTTTGCCGTGACCTTCAGCGTGAAGAAGAACGCCG

ATTGTCTGGACACCACAAAGGACCTGAATGCCGAAGTGATGGAGCAGTATAGCGAGTCCAA

CAGACTGATCCTGATCAGGAATACCACAGATATCCTGTACTATCTGGTGCTGGACAAGAATG

GCAAGGTGCTGAAGCAGAGATCCCTGAACATCATCAATGACGGCGCCAGGGATGTGGACTG

GAAGGAGAGGTTCCGCCAGGTGACAAAGGATAGAAACGAGGGCTACAATGAGTGGGATTAT

TCCAGGACCTCTAACGACCTGAAGGAGGTGTACCTGAATTATGCCCTGAAGGAGATCGCCG

AGGCCGTGATCGAGTACAACGCCATCCTGATCATCGAGAAGATGTCTAATGCCTTTAAGGAC

AAGTATAGCTTCCTGGACGACGTGACCTTCAAGGGCTTCGAGACAAAGCTGCTGGCCAAGCT

GAGCGATCTGCACTTTAGGGGCATCAAGGACGGCGAGCCATGTTCCTTCACAAACCCCCTGC

AGCTGTGCCAGAACGATTCTAATAAGATCCTGCAGGACGGCGTGATCTTTATGGTGCCAAAT

TCTATGACACGGAGCCTGGACCCCGACACCGGCTTCATCTTTGCCATCAACGACCACAATAT

CAGGACCAAGAAGGCCAAGCTGAACTTTCTGAGCAAGTTCGATCAGCTGAAGGTGTCCTCTG

AGGGCTGCCTGATCATGAAGTACAGCGGCGATTCCCTGCCTACACACAACACCGACAATCGC

GTGTGGAACTGCTGTTGCAATCACCCAATCACAAACTATGACCGGGAGACAAAGAAGGTGG

AGTTCATCGAGGAGCCCGTGGAGGAGCTGTCCCGCGTGCTGGAGGAGAATGGCATCGAGAC

AGACACCGAGCTGAACAAGCTGAATGAGCGGGAGAACGTGCCTGGCAAGGTGGTGGATGCC

ATCTACTCTCTGGTGCTGAATTATCTGCGCGGCACAGTGAGCGGAGTGGCAGGACAGAGGG

CCGTGTACTATAGCCCTGTGACCGGCAAGAAGTACGATATCTCCTTTATCCAGGCCATGAAC

CTGAATAGGAAGTGTGACTACTATAGGATCGGCTCCAAGGAGAGGGGAGAGTGGACCGATT

TCGTGGCCCAGCTGATCAACAAAAGGCCGGCGGCCACGAAAAAGGCCGGCCAGGCAAAAAGA

AAAAGGGATCCTACCCATACGATGTTCCAGATTACGCTTATCCCTACGACGTGCCTGATT

ATGCATACCCATATGATGTCCCCGACTATGCC
```

4- Butyrivibrio proteoclasticus (BpCpf1)

(SEQ ID NO: 216)
```
ATGAGCATCTACCAGGAGTTCGTCAACAAGTATTCACTGAGTAAGACACTGCGGTTCGAGCT

GATCCCACAGGGCAAGACACTGGAGAACATCAAGGCCCGAGGCCTGATTCTGGACGATGAG

AAGCGGGCAAAAGACTATAAGAAAGCCAAGCAGATCATTGATAAATACCACCAGTTCTTTA

TCGAGGAAATTCTGAGCTCCGTGTGCATCAGTGAGGATCTGCTGCAGAATTACTCAGACGTG

TACTTCAAGCTGAAGAAGAGCGACGATGACAACCTGCAGAAGGACTTCAAGTCCGCCAAGG
```

-continued

```
ACACCATCAAGAAACAGATTAGCGAGTACATCAAGGACTCCGAAAAGTTTAAAAATCTGTT

CAACCAGAATCTGATCGATGCTAAGAAAGGCCAGGAGTCCGACCTGATCCTGTGGCTGAAA

CAGTCTAAGGACAATGGGATTGAACTGTTCAAGGCTAACTCCGATATCACTGATATTGACGA

GGCACTGGAAATCATCAAGAGCTTCAAGGGATGGACCACATACTTTAAAGGCTTCCACGAG

AACCGCAAGAACGTGTACTCCAGCAACGACATTCCTACCTCCATCATCTACCGAATCGTCGA

TGACAATCTGCCAAAGTTCCTGGAGAACAAGGCCAAATATGAATCTCTGAAGGACAAAGCT

CCCGAGGCAATTAATTACGAACAGATCAAGAAAGATCTGGCTGAGGAACTGACATTCGATA

TCGACTATAAGACTAGCGAGGTGAACCAGAGGGTCTTTTCCCTGGACGAGGTGTTTGAAATC

GCCAATTTCAACAATTACCTGAACCAGTCCGGCATTACTAAATTCAATACCATCATTGGCGG

GAAGTTTGTGAACGGGGAGAATACCAAGCGCAAGGGAATTAACGAATACATCAATCTGTAT

AGCCAGCAGATCAACGACAAAACTCTGAAGAAATACAAGATGTCTGTGCTGTTCAAACAGA

TCCTGAGTGATACCGAGTCCAAGTCTTTTGTCATTGATAAACTGGAAGATGACTCAGACGTG

GTCACTACCATGCAGAGCTTTTATGAGCAGATCGCCGCTTTCAAGACAGTGGAGGAAAAATC

TATTAAGGAAACTCTGAGTCTGCTGTTCGATGACCTGAAAGCCCAGAAGCTGGACCTGAGTA

AGATCTACTTCAAAAACGATAAGAGTCTGACAGACCTGTCACAGCAGGTGTTTGATGACTAT

TCCGTGATTGGGACCGCCGTCCTGGAGTACATTACACAGCAGATCGCTCCAAAGAACCTGGA

TAATCCCTCTAAGAAAGAGCAGGAACTGATCGCTAAGAAAACCGAGAAGGCAAAATATCTG

AGTCTGGAAACAATTAAGCTGGCACTGGAGGAGTTCAACAAGCACAGGGATATTGACAAAC

AGTGCCGCTTTGAGGAAATCCTGGCCAACTTCGCAGCCATCCCCATGATTTTTGATGAGATC

GCCCAGAACAAAGACAATCTGGCTCAGATCAGTATTAAGTACCAGAACCAGGGCAAGAAAG

ACCTGCTGCAGGCTTCAGCAGAAGATGACGTGAAAGCCATCAAGGATCTGCTGGACCAGAC

CAACAATCTGCTGCACAAGCTGAAAATCTTCCATATTAGTCAGTCAGAGGATAAGGCTAATA

TCCTGGATAAAGACGAACACTTCTACCTGGTGTTCGAGGAATGTTACTTCGAGCTGGCAAAC

ATTGTCCCCCTGTATAACAAGATTAGGAACTACATCACACAGAAGCCTTACTCTGACGAGAA

GTTTAAACTGAACTTCGAAAATAGTACCCTGGCCAACGGGTGGGATAAGAACAAGGAGCCT

GACAACACAGCTATCCTGTTCATCAAGGATGACAAGTACTATCTGGGAGTGATGAATAAGA

AAAACAATAAGATCTTCGATGACAAAGCCATTAAGGAGAACAAAGGGGAAGGATACAAGA

AAATCGTGTATAAGCTGCTGCCCGGCGCAAATAAGATGCTGCCTAAGGTGTTCTTCAGCGCC

AAGAGTATCAAATTCTACAACCCATCCGAGGACATCCTGCGGATTAGAAATCACTCAACACA

TACTAAGAACGGGAGCCCCCAGAAGGGATATGAGAAATTTGAGTTCAACATCGAGGATTGC

AGGAAGTTTATTGACTTCTACAAGCAGAGCATCTCCAAACACCCTGAATGGAAGGATTTTGG

CTTCCGGTTTTCCGACACACAGAGATATAACTCTATCGACGAGTTCTACCGCGAGGTGGAAA

ATCAGGGGTATAAGCTGACTTTTGAGAACATTTCTGAAAGTTACATCGACAGCGTGGTCAAT

CAGGGAAAGCTGTACCTGTTCCAGATCTATAACAAAGATTTTTCAGCATACAGCAAGGGCAG

ACCAAACCTGCATACACTGTACTGGAAGGCCCTGTTCGATGAGAGGAATCTGCAGGACGTG

GTCTATAAACTGAACGGAGAGGCCGAACTGTTTTACCGGAAGCAGTCTATTCCTAAGAAAAT

CACTCACCCAGCTAAGGAGGCCATCGCTAACAAGAACAAGGACAATCCTAAGAAAGAGAGC

GTGTTCGAATACGATCTGATTAAGGACAAGCGGTTCACCGAAGATAAGTTCTTTTTCCATTG

TCCAATCACCATTAACTTCAAGTCAAGCGGCGCTAACAAGTTCAACGACGAGATCAATCTGC

TGCTGAAGGAAAAAGCAAACGATGTGCACATCCTGAGCATTGACCGAGGAGAGCGGCATCT
```

-continued
GGCCTACTATACCCTGGTGGATGGCAAAGGGAATATCATTAAGCAGGATACATTCAACATCA

TTGGCAATGACCGGATGAAAACCAACTACCACGATAAACTGGCTGCAATCGAGAAGGATAG

AGACTCAGCTAGGAAGGACTGGAAGAAAATCAACAACATTAAGGAGATGAAGGAAGGCTA

TCTGAGCCAGGTGGTCCATGAGATTGCAAAGCTGGTCATCGAATACAATGCCATTGTGGTGT

TCGAGGATCTGAACTTCGGCTTTAAGAGGGGGCGCTTTAAGGTGGAAAAACAGGTCTATCA

GAAGCTGGAGAAAATGCTGATCGAAAAGCTGAATTACCTGGTGTTTAAAGATAACGAGTTC

GACAAGACCGGAGGCGTCCTGAGAGCCTACCAGCTGACAGCTCCCTTTGAAACTTTCAAGA

AAATGGGAAAACAGACAGGCATCATCTACTATGTGCCAGCCGGATTCACTTCCAAGATCTGC

CCCGTGACCGGCTTTGTCAACCAGCTGTACCCTAAATATGAGTCAGTGAGCAAGTCCCAGGA

ATTTTTCAGCAAGTTCGATAAGATCTGTTATAATCTGGACAAGGGGTACTTCGAGTTTTCCTT

CGATTACAAGAACTTCGGCGACAAGGCCGCTAAGGGGAAATGGACCATTGCCTCCTTCGGA

TCTCGCCTGATCAACTTTCGAAATTCCGATAAAAACCACAATTGGGACACTAGGGAGGTGTA

CCCAACCAAGGAGCTGGAAAAGCTGCTGAAAGACTACTCTATCGAGTATGGACATGGCGAA

TGCATCAAGGCAGCCATCTGTGGCGAGAGTGATAAGAAATTTTTCGCCAAGCTGACCTCAGT

GCTGAATACAATCCTGCAGATGCGGAACTCAAAGACCGGGACAGAACTGGACTATCTGATT

AGCCCCGTGGCTGATGTCAACGGAAACTTCTTCGACAGCAGACAGGCACCCAAAAATATGC

CTCAGGATGCAGACGCCAACGGGGCCTACCACATCGGGCTGAAGGGACTGATGCTGCTGGG

CCGGATCAAGAACAATCAGGAGGGGAAGAAGCTGAACCTGGTCATTAAGAACGAGGAATA

CTTCGAGTTTGTCCAGAATAGAAATAACAAAAGGCCGGCGGCCACGAAAAAGGCCGGCCAGGC

*AAAAAAGAAAAAG*<u>GGATCC</u>TACCCATACGATGTTCCAGATTACGCTTATCCCTACGACGTG

CCTGATTATGCATACCCATATGATGTCCCCGACTATGCC
5- Peregrinibacteria bacterium GW2011_GWA_33_10 (PeCpf1)
(SEQ ID NO. 217)
ATGTCCAACTTCTTTAAGAATTTCACCAACCTGTATGAGCTGTCCAAGACACTGAGGTTTGA

GCTGAAGCCCGTGGGCGACACCCTGACAAACATGAAGGACCACCTGGAGTACGATGAGAAG

CTGCAGACCTTCCTGAAGGATCAGAATATCGACGATGCCTATCAGGCCCTGAAGCCTCAGTT

CGACGAGATCCACGAGGAGTTTATCACAGATTCTCTGGAGAGCAAGAAGGCCAAGGAGATC

GACTTCTCCGAGTACCTGGATCTGTTTCAGGAGAAGAAGGAGCTGAACGACTCTGAGAAGA

AGCTGCGCAACAAGATCGGCGAGACATTCAACAAGGCCGGCGAGAAGTGGAAGAAGGAGA

AGTACCCTCAGTATGAGTGGAAGAAGGGCTCCAAGATCGCCAATGGCGCCGACATCCTGTCT

TGCCAGGATATGCTGCAGTTTATCAAGTATAAGAACCCAGGAGGATGAGAAGATCAAGAATT

ACATCGACGATACACTGAAGGGCTTCTTTACCTATTTCGGCGGCTTTAATCAGAACAGGGCC

AACTACTATGAGACAAAGAAGGAGGCCTCCACCGCAGTGGCAACAAGGATCGTGCACGAGA

ACCTGCCAAAGTTCTGTGACAATGTGATCCAGTTTAAGCACATCATCAAGCGGAAGAAGGAT

GGCACCGTGGAGAAAACCGAGAGAAAGACCGAGTACCTGAACGCCTACCAGTATCTGAAGA

ACAATAACAAGATCACACAGATCAAGGACGCCGAGACAGAGAAGATGATCGAGTCTACACC

CATCGCCGAGAAGATCTTCGACGTGTACTACTTCAGCAGCTGCCTGAGCCAGAAGCAGATCG

AGGAGTACAACCGGATCATCGGCCACTATAATCTGCTGATCAACCTGTATAACCAGGCCAAG

AGATCTGAGGGCAAGCACCTGAGCGCCAACGAGAAGAAGTATAAGGACCTGCCTAAGTTCA

AGACCCTGTATAAGCAGATCGGCTGCGGCAAGAAGAAGGACCTGTTTTACACAATCAAGTG

TGATACCGAGGAGGAGGCCAATAAGTCCCGGAACGAGGGCAAGGAGTCCCACTCTGTGGAG

GAGATCATCAACAAGGCCCAGGAGGCCATCAATAAGTACTTCAAGTCTAATAACGACTGTG

-continued

AGAATATCAACACCGTGCCCGACTTCATCAACTATATCCTGACAAAGGAGAATTACGAGGG

CGTGTATTGGAGCAAGGCCGCCATGAACACCATCTCCGACAAGTACTTCGCCAATTATCACG

ACCTGCAGGATAGACTGAAGGAGGCCAAGGTGTTTCAGAAGGCCGATAAGAAGTCCGAGGA

CGATATCAAGATCCCAGAGGCCATCGAGCTGTCTGGCCTGTTCGGCGTGCTGGACAGCCTGG

CCGATTGGCAGACCACACTGTTTAAGTCTAGCATCCTGAGCAACGAGGACAAGCTGAAGAT

CATCACAGATTCCCAGACCCCCTCTGAGGCCCTGCTGAAGATGATCTTCAATGACATCGAGA

AGAACATGGAGTCCTTTCTGAAGGAGACAAACGATATCATCACCCTGAAGAAGTATAAGGG

CAATAAGGAGGGCACCGAGAAGATCAAGCAGTGGTTCGACTATACACTGGCCATCAACCGG

ATGCTGAAGTACTTTCTGGTGAAGGAGAATAAGATCAAGGGCAACTCCCTGGATACCAATAT

CTCTGAGGCCCTGAAAACCCTGATCTACAGCGACGATGCCGAGTGGTTCAAGTGGTACGACG

CCCTGAGAAACTATCTGACCCAGAAGCCTCAGGATGAGGCCAAGGAGAATAAGCTGAAGCT

GAATTTCGACAACCCATCTCTGGCCGGCGGCTGGGATGTGAACAAGGAGTGCAGCAATTTTT

GCGTGATCCTGAAGGACAAGAACGAGAAGAAGTACCTGGCCATCATGAAGAAGGGCGAGA

ATACCCTGTTCCAGAAGGAGTGGACAGAGGGCCGGGGCAAGAACCTGACAAAGAAGTCTAA

TCCACTGTTCGAGATCAATAACTGCGAGATCCTGAGCAAGATGGAGTATGACTTTTGGGCCG

ACGTGAGCAAGATGATCCCCAAGTGTAGCACCCAGCTGAAGGCCGTGGTGAACCACTTCAA

GCAGTCCGACAATGAGTTCATCTTTCCTATCGGCTACAAGGTGACAAGCGGCGAGAAGTTTA

GGGAGGAGTGCAAGATCTCCAAGCAGGACTTCGAGCTGAATAACAAGGTGTTTAATAAGAA

CGAGCTGAGCGTGACCGCCATGCGCTACGATCTGTCCTCTACACAGGAGAAGCAGTATATCA

AGGCCTTCCAGAAGGAGTACTGGGAGCTGCTGTTTAAGCAGGAGAAGCGGGACACCAAGCT

GACAAATAACGAGATCTTCAACGAGTGGATCAATTTTTGCAACAAGAAGTATAGCGAGCTG

CTGTCCTGGGAGAGAAAGTACAAGGATGCCCTGACCAATTGGATCAACTTCTGTAAGTACTT

TCTGAGCAAGTATCCCAAGACCACACTGTTCAACTACTCTTTTAAGGAGAGCGAGAATTATA

ACTCCCTGGACGAGTTCTACCGGGACGTGGATATCTGTTCTTACAAGCTGAATATCAACACC

ACAATCAATAAGAGCATCCTGGATAGACTGGTGGAGGAGGGCAAGCTGTACCTGTTTGAGA

TCAAGAATCAGGACAGCAACGATGGCAAGTCCATCGGCCACAAGAATAACCTGCACACCAT

CTACTGGAACGCCATCTTCGAGAATTTTGACAACAGGCCTAAGCTGAATGGCGAGGCCGAG

ATCTTCTATCGCAAGGCCATCTCCAAGGATAAGCTGGGCATCGTGAAGGGCAAGAAAACCA

AGAACGGCACCGAGATCATCAAGAATTACAGATTCAGCAAGGAGAAGTTTATCCTGCACGT

GCCAATCACCCTGAACTTCTGCTCCAATAACGAGTATGTGAATGACATCGTGAACACAAAGT

TCTACAATTTTTCCAACCTGCACTTTCTGGGGCATCGATAGGGGCGAGAAGCACCTGGCCTAC

TATTCTCTGGTGAATAAGAACGGCGAGATCGTGGACCAGGGCACACTGAACCTGCCTTTCAC

CGACAAGGATGGCAATCAGCGCAGCATCAAGAAGGAGAAGTACTTTTATAACAAGCAGGAG

GACAAGTGGGAGGCCAAGGAGGTGGATTGTTGGAATTATAACGACCTGCTGGATGCCATGG

CCTCTAACCGGGACATGGCCAGAAAGAATTGGCAGAGGATCGGCACCATCAAGGAGGCCAA

GAACGGCTACGTGAGCCTGGTCATCAGGAAGATCGCCGATCTGGCCGTGAATAACGAGCGC

CCCGCCTTCATCGTGCTGGAGGACCTGAATACAGGCTTTAAGCGGTCCAGACAGAAGATCGA

TAAGAGCGTGTACCAGAAGTTCGAGCTGGCCCTGGCCAAGAAGCTGAACTTTCTGGTGGAC

AAGAATGCCAAGCGCGATGAGATCGGCTCCCCTACAAAGGCCCTGCAGCTGACCCCCCCTGT

GAATAACTACGCGACATTGAGAACAAGAAGCAGGCCGGCATCATGCTGTATACCCGGGCC

AATTATACCTCTCAGACAGATCCAGCCACAGGCTGGAGAAAGACCATCTATCTGAAGGCCG

-continued

```
GCCCCGAGGAGACAACATACAAGAAGGACGGCAAGATCAAGAACAAGAGCGTGAAGGACC
AGATCATCGAGACATTCACCGATATCGGCTTTGACGGCAAGGATTACTATTTCGAGTACGAC
AAGGGCGAGTTTGTGGATGAGAAAACCGGCGAGATCAAGCCCAAGAAGTGGCGGCTGTACT
CCGGCGAGAATGGCAAGTCCCTGGACAGGTTCCGCGGAGAGAGGGAGAAGGATAAGTATG
AGTGGAAGATCGACAAGATCGATATCGTGAAGATCCTGGACGATCTGTTCGTGAATTTTGAC
AAGAACATCAGCCTGCTGAAGCAGCTGAAGGAGGGCGTGGAGCTGACCCGGAATAACGAGC
ACGGCACAGGCGAGTCCCTGAGATTCGCCATCAACCTGATCCAGCAGATCCGGAATACCGG
CAATAACGAGAGAGACAACGATTTCATCCTGTCCCCAGTGAGGGACGAGAATGGCAAGCAC
TTTGACTCTCGCGAGTACTGGGATAAGGAGACAAAGGGCGAGAAGATCAGCATGCCCAGCT
CCGGCGATGCCAATGGCGCCTTCAACATCGCCCGGAAGGGCATCATCATGAACGCCCACATC
CTGGCCAATAGCGACTCCAAGGATCTGTCCCTGTTCGTGTCTGACGAGGAGTGGGATCTGCA
CCTGAATAACAAGACCGAGTGGAAGAAGCAGCTGAACATCTTTTCTAGCAGGAAGGCCATG
GCCAAGCGCAAGAAGAAAAGGCCGGCGGCCACGAAAAAGGCCGGCCAGGCAAAAAAGAAAAAG
GGATCCTACCCATACGATGTTCCAGATTACGCTTATCCCTACGACGTGCCTGATTATGC

ATACCCATATGATGTCCCCGACTATGCCTAAGAATTC
```
6- Parcubacteria bacterium GWC2011_GWC2_44_17 (PbCpfl)

(SEQ ID NO: 218)
```
ATGGAGAACATCTTCGACCAGTTTATCGGCAAGTACAGCCTGTCCAAGACCCTGAGATTCGA
GCTGAAGCCCGTGGGCAAGACAGAGGACTTCCTGAAGATCAACAAGGTGTTTGAGAAGGAT
CAGACCATCGACGATAGCTACAATCAGGCCAAGTTCTATTTTGATTCCCTGCACCAGAAGTT
TATCGACGCCGCCCTGGCCTCCGATAAGACATCCGAGCTGTCTTTCCAGAACTTTGCCGACG
TGCTGGAGAAGCAGAATAAGATCATCCTGGATAAGAAGAGAGAGATGGGCGCCCTGAGGA
AGCGCGACAAGAACGCCGTGGGCATCGATAGGCTGCAGAAGGAGATCAATGACGCCGAGG
ATATCATCCAGAAGGAGAAGGAGAAGATCTACAAGGACGTGCGCACCCTGTTCGATAACGA
GGCCGAGTCTTGGAAAACCTACTATCAGGAGCGGGAGGTGGACGGCAAGAAGATCACCTTC
AGCAAGGCCGACCTGAAGCAGAAGGGCGCCGATTTTCTGACAGCCGCCGGCATCCTGAAGG
TGCTGAAGTATGAGTTCCCCGAGGAGAAGGAGAAGGAGTTTCAGGCCAAGAACCAGCCCTC
CCTGTTCGTGGAGGAGAAGGAGAATCCTGGCCAGAAGAGGTACATCTTCGACTCTTTTGATA
AGTTCGCCGGCTATCTGACCAAGTTTCAGCAGACAAAGAAGAATCTGTACGCAGCAGACGG
CACCAGCACAGCAGTGGCCACCCGCATCGCCGATAACTTTATCATCTTCCACCAGAATACCA
AGGTGTTCCGGGACAAGTACAAGAACAATCACACAGACCTGGGCTTCGATGAGGAGAACAT
CTTTGAGATCGAGAGGTATAAGAATTGCCTGCTGCAGCGCGAGATCGAGCACATCAAGAAT
GAGAATAGCTACAACAAGATCATCGGCCGGATCAATAAGAAGATCAAGGAGTATCGGGACC
AGAAGGCCAAGGATACCAAGCTGACAAAGTCCGACTTCCCTTTCTTTAAGAACCTGGATAAG
CAGATCCTGGGCGAGGTGGAGAAGGAGAAGCAGCTGATCGAGAAAACCCGGGAGAAAACC
GAGGAGGACGTGCTGATCGAGCGGTTCAAGGAGTTCATCGAGAACAATGAGGAGAGGTTCA
CCGCCGCCAAGAAGCTGATGAATGCCTTCTGTAACGGCGAGTTTGAGTCCGAGTACGAGGG
CATCTATCTGAAGAATAAGGCCATCAACACAATCTCCCGGAGATGGTTCGTGTCTGACAGAG
ATTTTGAGCTGAAGCTGCCTCAGCAGAAGTCCAAGAACAAGTCTGAGAAGAATGAGCCAAA
GGTGAAGAAGTTCATCTCCATCGCCGAGATCAAGAACGCCGTGGAGGAGCTGGACGGCGAT
ATCTTTAAGGCCGTGTTCTACGACAAGAAGATCATCGCCCAGGGCGGCTCTAAGCTGGAGCA
GTTCCTGGTCATCTGGAAGTACGAGTTTGAGTATCTGTTCCGGGACATCGAGAGAGAGAACG
```

-continued

```
GCGAGAAGCTGCTGGGCTATGATAGCTGCCTGAAGATCGCCAAGCAGCTGGGCATCTTCCCA

CAGGAGAAGGAGGCCCGCGAGAAGGCAACCGCCGTGATCAAGAATTACGCCGACGCCGGC

CTGGGCATCTTCCAGATGATGAAGTATTTTTCTCTGGACGATAAGGATCGGAAGAACACCCC

CGGCCAGCTGAGCACAAATTTCTACGCCGAGTATGACGGCTACTACAAGGATTTCGAGTTTA

TCAAGTACTACAACGAGTTTAGGAACTTCATCACCAAGAAGCCTTTCGACGAGGATAAGATC

AAGCTGAACTTTGAGAATGGCGCCCTGCTGAAGGGCTGGGACGAGAACAAGGAGTACGATT

TCATGGGCGTGATCCTGAAGAAGGAGGGCCGCCTGTATCTGGGCATCATGCACAAGAACCA

CCGGAAGCTGTTTCAGTCCATGGGCAATGCCAAGGGCGACAACGCCAATAGATACCAGAAG

ATGATCTATAAGCAGATCGCCGACGCCTCTAAGGATGTGCCCAGGCTGCTGCTGACCAGCAA

GAAGGCCATGGAGAAGTTCAAGCCTTCCCAGGAGATCCTGAGAATCAAGAAGGAGAAAACC

TTCAAGCGGGAGAGCAAGAACTTTTCCCTGAGAGATCTGCACGCCCTGATCGAGTACTATAG

GAACTGCATCCCTCAGTACAGCAATTGGTCCTTTTATGACTTCCAGTTTCAGGATACCGGCA

AGTACCAGAATATCAAGGAGTTCACAGACGATGTGCAGAAGTACGGCTATAAGATCTCCTTT

CGCGACATCGACGATGAGTATATCAATCAGGCCCTGAACGAGGGCAAGATGTACCTGTTCG

AGGTGGTGAACAAGGATATCTATAACACCAAGAATGGCTCCAAGAATCTGCACACACTGTA

CTTTGAGCACATCCTGTCTGCCGAGAACCTGAATGACCCAGTGTTCAAGCTGTCTGGCATGG

CCGAGATCTTTCAGCGGCAGCCCAGCGTGAACGAAAGAGAGAAGATCACCACACAGAAGAA

TCAGTGTATCCTGGACAAGGGCGATAGAGCCTACAAGTATAGGCGCTACACCGAGAAGAAG

ATCATGTTCCACATGAGCCTGGTGCTGAACACAGGCAAGGGCGAGATCAAGCAGGTGCAGT

TTAATAAGATCATCAACCAGAGGATCAGCTCCTCTGACAACGAGATGAGGGTGAATGTGAT

CGGCATCGATCGCGGCGAGAAGAACCTGCTGTACTATAGCGTGGTGAAGCAGAATGGCGAG

ATCATCGAGCAGGCCTCCCTGAACGAGATCAATGGCGTGAACTACCGGGACAAGCTGATCG

AGAGGGAGAAGGAGCGCCTGAAGAACCGGCAGAGCTGGAAGCCTGTGGTGAAGATCAAGG

ATCTGAAGAAGGGCTACATCTCCCACGTGATCCACAAGATCTGCCAGCTGATCGAGAAGTAT

TCTGCCATCGTGGTGCTGGAGGACCTGAATATGAGATTCAAGCAGATCAGGGGAGGAATCG

AGCGGAGCGTGTACCAGCAGTTCGAGAAGGCCCTGATCGATAAGCTGGGCTATCTGGTGTTT

AAGGACAACAGGGATCTGAGGGCACCAGGAGGCGTGCTGAATGGCTACCAGCTGTCTGCCC

CCTTTGTGAGCTTCGAGAAGATGCGCAAGCAGACCGGCATCCTGTTCTACACACAGGCCGAG

TATACCAGCAAGACAGACCCAATCACCGGCTTTCGGAAGAACGTGTATATCTCTAATAGCGC

CTCCCTGGATAAGATCAAGGAGGCCGTGAAGAAGTTCGACGCCATCGGCTGGGATGGCAAG

GAGCAGTCTTACTTCTTTAAGTACAACCCTTACAACCTGGCCGACGAGAAGTATAAGAACTC

TACCGTGAGCAAGGAGTGGGCCATCTTTGCCAGCGCCCCAAGAATCCGGAGACAGAAGGGC

GAGGACGGCTACTGGAAGTATGATAGGGTGAAAGTGAATGAGGAGTTCGAGAAGCTGCTGA

AGGTCTGGAATTTTGTGAACCCAAAGGCCACAGATATCAAGCAGGAGATCATCAAGAAGGA

GAAGGCAGGCGACCTGCAGGGAGAAGGAGCTGGATGGCCGGCTGAGAAACTTTTGGCAC

TCTTTCATCTACCTGTTTAACCTGGTGCTGGAGCTGCGCAATTCTTTCAGCCTGCAGATCAAG

ATCAAGGCAGGAGAAGTGATCGCAGTGGACGAGGGCGTGGACTTCATCGCCAGCCCAGTGA

AGCCCTTCTTTACCACACCCAACCCTTACATCCCCTCCAACCTGTGCTGGCTGGCCGTGGAGA

ATGCAGACGCAAACGGAGCCTATAATATCGCCAGGAAGGGCGTGATGATCCTGAAGAAGAT

CCGCGAGCACGCCAAGAAGGACCCCGAGTTCAAGAAGCTGCCAAACCTGTTTATCAGCAAT
```

-continued

GCAGAGTGGGACGAGGCAGCCCGGGATTGGGGCAAGTACGCAGGCACCACAGCCCTGAACC

TGGACCAC*AAAAGGCCGGCGGCCACGAAAAAGGCCGGCCAGGCAAAAAAGAAAAAG*<u>GGATCCT</u>

ACCCATACGATGTTCCAGATTACGCTTATCCCTACGACGTGCCTGATTATGCATACCCA

TATGATGTCCCCGACTATGCCTAAGAATTC
7- Smithella sp. SC_K08D17 (SsCpf1)

(SEQ ID NO: 219)

ATGCAGACCCTGTTTGAGAACTTCACAAATCAGTACCCAGTGTCCAAGACCCTGCGCTTTGA

GCTGATCCCCCAGGGCAAGACAAAGGACTTCATCGAGCAGAAGGGCCTGCTGAAGAAGGAT

GAGGACCGGGCCGAGAAGTATAAGAAGGTGAAGAACATCATCGATGAGTACCACAAGGAC

TTCATCGAGAAGTCTCTGAATGGCCTGAAGCTGGACGGCCTGGAGAAGTACAAGACCCTGT

ATCTGAAGCAGGAGAAGGACGATAAGGATAAGAAGGCCTTTGACAAGGAGAAGGAGAACC

TGCGCAAGCAGATCGCCAATGCCTTCCGGAACAATGAGAAGTTTAAGACACTGTTCGCCAA

GGAGCTGATCAAGAACGATCTGATGTCTTTCGCCTGCGAGGAGGACAAGAAGAATGTGAAG

GAGTTTGAGGCCTTCACCACATACTTCACCGGCTTCCACCAGAACCGCGCCAATATGTACGT

GGCCGATGAGAAGAGAACAGCCATCGCCAGCAGGCTGATCCACGAGAACCTGCCAAAGTTT

ATCGACAATATCAAGATCTTCGAGAAGATGAAGAAGGAGGCCCCCGAGCTGCTGTCTCCTTT

CAACCAGACCCTGAAGGATATGAAGGACGTGATCAAGGGCACCACACTGGAGGAGATCTTT

AGCCTGGATTATTTCAACAAGACCCTGACACAGAGCGGCATCGACATCTACAATTCCGTGAT

CGGCGGCAGAACCCCTGAGGAGGGCAAGACAAAGATCAAGGGCCTGAACGAGTACATCAA

TACCGACTTCAACCAGAAGCAGACAGACAAGAAGAAGCGGCAGCCAAAGTTCAAGCAGCTG

TATAAGCAGATCCTGAGCGATAGGCAGAGCCTGTCCTTTATCGCCGAGGCCTTCAAGAACGA

CACCGAGATCCTGGAGGCCATCGAGAAGTTTTACGTGAATGAGCTGCTGCACTTCAGCAATG

AGGGCAAGTCCACAAACGTGCTGGACGCCATCAAGAATGCCGTGTCTAACCTGGAGAGCTT

TAACCTGACCAAGATGTATTTCCGCTCCGGCGCCTCTCTGACAGACGTGAGCCGGAAGGTGT

TTGGCGAGTGGAGCATCATCAATAGAGCCCTGGACAACTACTATGCCACCACATATCCAATC

AAGCCCAGAGAAGTCTGAGAAGTACGAGGAGAGGAAGGAGAAGTGGCTGAAGCAGGAC

TTCAACGTGAGCCTGATCCAGACCGCCATCGATGAGTACGACAACGAGACAGTGAAGGGCA

AGAACAGCGGCAAAGTGATCGCCGATTATTTTGCCAAGTTCTGCGACGATAAGGAGACAGA

CCTGATCCAGAAGGTGAACGAGGGCTACATCGCCGTGAAGGATCTGCTGAATACACCCTGTC

CTGAGAACGAGAAGCTGGGCAGCAATAAGGACCAGGTGAAGCAGATCAAGGCCTTTATGGA

TTCTATCATGGACATCATGCACTTCGTGCGCCCCCTGAGCCTGAAGGATACCGACAAGGAGA

AGGATGAGACATTCTACTCCCTGTTCACACCTCTGTACGACCACCTGACCCAGACAATCGCC

CTGTATAACAAGGTGCGGAACTATCTGACCCAGAAGCCTTACAGCACAGAGAAGATCAAGC

TGAACTTCGAGAACAGCACCCTGCTGGGCGGCTGGGATCTGAATAAGGAGACAGACAACAC

AGCCATCATCCTGAGGAAGGATAACCTGTACTATCTGGGCATCATGGACAAGAGGCACAAT

CGCATCTTTCGGAACGTGCCCAAGGCCGATAAGAAGGACTTCTGCTACGAGAAGATGGTGT

ATAAGCTGCTGCCTGGCGCCAACAAGATGCTGCCAAAGGTGTTCTTTTCTCAGAGCAGAATC

CAGGAGTTTACCCCTTCCGCCAAGCTGCTGGAGAACTACGCCAATGAGACACACAAGAAGG

GCGATAATTTCAACCTGAATCACTGTCACAAGCTGATCGATTTCTTTAAGGACTCTATCAAC

AAGCACGAGGATTGGAAGAATTTCGACTTTAGGTTCAGCGCCACCTCCACCTACGCCGACCT

GAGCGGCTTTTACCACGAGGTGGAGCACCAGGGCTACAAGATCTCTTTTCAGAGCGTGGCCG

ATTCCTTCATCGACGATCTGGTGAACGAGGGCAAGCTGTACCTGTTCCAGATCTATAATAAG

-continued

```
GACTTTTCCCCATTCTCTAAGGGCAAGCCCAACCTGCACACCCTGTACTGGAAGATGCTGTTT
GATGAGAACAATCTGAAGGACGTGGTGTATAAGCTGAATGGCGAGGCCGAGGTGTTCTACC
GCAAGAAGAGCATTGCCGAGAAGAACACCACAATCCACAAGGCCAATGAGTCCATCATCAA
CAAGAATCCTGATAACCCAAAGGCCACCAGCACCTTCAACTATGATATCGTGAAGGACAAG
AGATACACCATCGACAAGTTTCAGTTCCACATCCCAATCACAATGAACTTTAAGGCCGAGGG
CATCTTCAACATGAATCAGAGGGTGAATCAGTTCCTGAAGGCCAATCCCGATATCAACATCA
TCGGCATCGACAGAGGCGAGAGGCACCTGCTGTACTATGCCCTGATCAACCAGAAGGGCAA
GATCCTGAAGCAGGATACCCTGAATGTGATCGCCAACGAGAAGCAGAAGGTGGACTACCAC
AATCTGCTGGATAAGAAGGAGGGCGACCGCGCAACCGCAAGGCAGGAGTGGGGCGTGATC
GAGACAATCAAGGAGCTGAAGGAGGGCTATCTGTCCCAGGTCATCCACAAGCTGACCGATC
TGATGATCGAGAACAATGCCATCATCGTGATGGAGGACCTGAACTTTGGCTTCAAGCGGGGC
AGACAGAAGGTGGAGAAGCAGGTGTATCAGAAGTTTGAGAAGATGCTGATCGATAAGCTGA
ATTACCTGGTGGACAAGAATAAGAAGGCAAACGAGCTGGGAGGCCTGCTGAACGCATTCCA
GCTGGCCAATAAGTTTGAGTCCTTCCAGAAGATGGGCAAGCAGAACGGCTTTATCTTCTACG
TGCCCGCCTGGAATACCTCTAAGACAGATCCTGCCACCGGCTTTATCGACTTCCTGAAGCCC
CGCTATGAGAACCTGAATCAGGCCAAGGATTTCTTTGAGAAGTTTGACTCTATCCGGCTGAA
CAGCAAGGCCGATTACTTTGAGTTCGCCTTTGACTTCAAGAATTTCACCGAGAAGGCCGATG
GCGGCAGAACCAAGTGGACAGTGTGCACCACAAACGAGGACAGATATGCCTGGAATAGGGC
CCTGAACAATAACAGGGGCAGCCAGGAGAAGTACGACATCACAGCCGAGCTGAAGTCCCTG
TTCGATGGCAAGGTGGACTATAAGTCTGGCAAGGATCTGAAGCAGCAGATCGCCAGCCAGG
AGTCCGCCGACTTCTTTAAGGCCCTGATGAAGAACCTGTCCATCACCCTGTCTCTGAGACAC
AATAACGGCGAGAAGGGCGATAATGAGCAGGACTACATCCTGTCCCCTGTGGCCGATTCTA
AGGGCCGCTTCTTTGACTCCCGGAAGGCCGACGATGACATGCCAAAGAATGCCGACGCCAA
CGGCGCCTATCACATCGCCCTGAAGGGCCTGTGGTGTCTGGAGCAGATCAGCAAGACCGAT
GACCTGAAGAAGGTGAAGCTGGCCATCTCCAACAAGGAGTGGCTGGAGTTCGTGCAGACAC
TGAAGGGCAAAAGGCCGGCGGCCACGAAAAAGGCCGGCCAGGCAAAAAAGAAAAAGGGATCCT
ACCCATACGATGTTCCAGATTACGCTTATCCCTACGACGTGCCTGATTATGCATACCCA
TATGATGTCCCCGACTATGCCTAAGAATTC
```

8- Acidaminococcus sp. BV3L6 (AsCpf1)

(SEQ ID NO: 220)
```
ATGACACAGTTCGAGGGCTTTACCAACCTGTATCAGGTGAGCAAGACACTGCGGTTT
GAGCTGATCCCACAGGGCAAGACCCTGAAGCACATCCAGGAGCAGGGCTTCATCGA
GGAGGACAAGGCCCGCAATGATCACTACAAGGAGCTGAAGCCCATCATCGATCGGA
TCTACAAGACCTATGCCGACCAGTGCCTGCAGCTGGTGCAGCTGGATTGGGAGAAC
CTGAGCGCCGCCATCGACTCCTATAGAAAGGAGAAACCGAGGAGACAAGGAACG
CCCTGATCGAGGAGCAGGCCACATATCGCAATGCCATCCACGACTACTTCATCGGCC
GGACAGACAACCTGACCGATGCCATCAATAAGAGACACGCCGAGATCTACAAGGGC
CTGTTCAAGGCCGAGCTGTTTAATGGCAAGGTGCTGAAGCAGCTGGGCACCGTGAC
CACAACCGAGCACGAGAACGCCCTGCTGCGGAGCTTCGACAAGTTTACAACCTACT
TCTCCGGCTTTTATGAGAACAGGAAGAACGTGTTCAGCGCCGAGGATATCAGCACA
GCCATCCCACACCGCATCGTGCAGGACAACTTCCCCAAGTTTAAGGAGAATTGTCAC
ATCTTCACACGCCTGATCACCGCCGTGCCCAGCCTGCGGGAGCACTTTGAGAACGTG
```

-continued

```
AAGAAGGCCATCGGCATCTTCGTGAGCACCTCCATCGAGGAGGTGTTTTCCTTCCCT
TTTTATAACCAGCTGCTGACACAGACCCAGATCGACCTGTATAACCAGCTGCTGGGA
GGAATCTCTCGGGAGGCAGGCACCGAGAAGATCAAGGGCCTGAACGAGGTGCTGAA
TCTGGCCATCCAGAAGAATGATGAGACAGCCCACATCATCGCCTCCCTGCCACACA
GATTCATCCCCCTGTTTAAGCAGATCCTGTCCGATAGGAACACCCTGTCTTTCATCCT
GGAGGAGTTTAAGAGCGACGAGGAAGTGATCCAGTCCTTCTGCAAGTACAAGACAC
TGCTGAGAAACGAGAACGTGCTGGAGACAGCCGAGGCCCTGTTTAACGAGCTGAAC
AGCATCGACCTGACACACATCTTCATCAGCCACAAGAAGCTGGAGACAATCAGCAG
CGCCCTGTGCGACCACTGGGATACACTGAGGAATGCCCTGTATGAGCGGAGAATCT
CCGAGCTGACAGGCAAGATCACCAAGTCTGCCAAGGAGAAGGTGCAGCGCAGCCTG
AAGCACGAGGATATCAACCTGCAGGAGATCATCTCTGCCGCAGGCAAGGAGCTGAG
CGAGGCCTTCAAGCAGAAAACCAGCGAGATCCTGTCCCACGCACACGCCGCCCTGG
ATCAGCCACTGCCTACAACCCTGAAGAAGCAGGAGGAGAAGGAGATCCTGAAGTCT
CAGCTGGACAGCCTGCTGGGCCTGTACCACCTGCTGGACTGGTTTGCCGTGGATGAG
TCCAACGAGGTGGACCCCGAGTTCTCTGCCCGGCTGACCGGCATCAAGCTGGAGAT
GGAGCCTTCTCTGAGCTTCTACAACAAGGCCAGAAATTATGCCACCAAGAAGCCCT
ACTCCGTGGAGAAGTTCAAGCTGAACTTTCAGATGCCTACACTGGCCTCTGGCTGGG
ACGTGAATAAGGAGAAGAACAATGGCGCCATCCTGTTTGTGAAGAACGGCCTGTAC
TATCTGGGCATCATGCCAAAGCAGAAGGGCAGGTATAAGGCCCTGAGCTTCGAGCC
CACAGAGAAACCAGCGAGGGCTTTGATAAGATGTACTATGACTACTTCCCTGATGC
CGCCAAGATGATCCCAAAGTGCAGCACCCAGCTGAAGGCCGTGACAGCCCACTTTC
AGACCCACACAACCCCCATCCTGCTGTCCAACAATTTCATCGAGCCTCTGGAGATCA
CAAAGGAGATCTACGACCTGAACAATCCTGAGAAGGAGCCAAAGAAGTTTCAGACA
GCCTACGCCAAGAAAACCGGCGACCAGAAGGGCTACAGAGAGGCCCTGTGCAAGT
GGATCGACTTCACAAGGGATTTTCTGTCCAAGTATACCAAGACAACCTCTATCGATC
TGTCTAGCCTGCGGCCATCCTCTCAGTATAAGGACCTGGGCGAGTACTATGCCGAGC
TGAATCCCCTGCTGTACCACATCAGCTTCCAGAGAATCGCCGAGAAGGAGATCATG
GATGCCGTGGAGACAGGCAAGCTGTACCTGTTCCAGATCTATAACAAGGACTTTGCC
AAGGGCCACCACGGCAAGCCTAATCTGCACACACTGTATTGGACCGGCCTGTTTTCT
CCAGAGAACCTGGCCAAGACAAGCATCAAGCTGAATGGCCAGGCCGAGCTGTTCTA
CCGCCCTAAGTCCAGGATGAAGAGGATGGCACACCGGCTGGGAGAGAAGATGCTGA
ACAAGAAGCTGAAGGATCAGAAAACCCCAATCCCCGACACCCTGTACCAGGAGCTG
TACGACTATGTGAATCACAGACTGTCCCACGACCTGTCTGATGAGGCCAGGGCCCTG
CTGCCCAACGTGATCACCAAGGAGGTGTCTCACGAGATCATCAAGGATAGGCGCTTT
ACCAGCGACAAGTTCTTTTTCCACGTGCCTATCACACTGAACTATCAGGCCGCCAAT
TCCCCATCTAAGTTCAACCAGAGGGTGAATGCCTACCTGAAGGAGCACCCCGAGAC
ACCTATCATCGGCATCGATCGGGGCGAGAGAAACCTGATCTATATCACAGTGATCG
ACTCCACCGGCAAGATCCTGGAGCAGCGGAGCCTGAACACCATCCAGCAGTTTGAT
TACCAGAAGAAGCTGGACAACAGGGAGAAGGAGAGGGTGGCAGCAAGGCAGGCCT
GGTCTGTGGTGGGCACAATCAAGGATCTGAAGCAGGGCTATCTGAGCCAGGTCATC
CACGAGATCGTGGACCTGATGATCCACTACCAGGCCGTGGTGGTGCTGGAGAACCT
```

-continued

```
GAATTTCGGCTTTAAGAGCAAGAGGACCGGCATCGCCGAGAAGGCCGTGTACCAGC

AGTTCGAGAAGATGCTGATCGATAAGCTGAATTGCCTGGTGCTGAAGGACTATCCA

GCAGAGAAAGTGGGAGGCGTGCTGAACCCATACCAGCTGACAGACCAGTTCACCTC

CTTTGCCAAGATGGGCACCCAGTCTGGCTTCCTGTTTTACGTGCCTGCCCCATATACA

TCTAAGATCGATCCCCTGACCGGCTTCGTGGACCCCTTCGTGTGGAAAACCATCAAG

AATCACGAGAGCCGCAAGCACTTCCTGGAGGGCTTCGACTTTCTGCACTACGACGTG

AAAACCGGCGACTTCATCCTGCACTTTAAGATGAACAGAAATCTGTCCTTCCAGAGG

GGCCTGCCCGGCTTTATGCCTGCATGGGATATCGTGTTCGAGAAGAACGAGACACA

GTTTGACGCCAAGGGCACCCCTTTCATCGCCGGCAAGAGAATCGTGCCAGTGATCG

AGAATCACAGATTCACCGGCAGATACCGGGACCTGTATCCTGCCAACGAGCTGATC

GCCCTGCTGAGGAGAAGGGCATCGTGTTCAGGGATGGCTCCAACATCCTGCCAAA

GCTGCTGGAGAATGACGATTCTCACGCCATCGACACCATGGTGGCCCTGATCCGCAG

CGTGCTGCAGATGCGGAACTCCAATGCCGCCACAGGCGAGGACTATATCAACAGCC

CCGTGCGCGATCTGAATGGCGTGTGCTTCGACTCCGGTTTCAGAACCCAGAGTGGC

CCATGGACGCCGATGCCAATGGCGCCTACCACATCGCCCTGAAGGGCCAGCTGCTG

CTGAATCACCTGAAGGAGAGCAAGGATCTGAAGCTGCAGAACGGCATCTCCAATCA

GGACTGGCTGGCCTACATCCAGGAGCTGCGCAACAAAAGGCCGGCGGCCACGAAAAA

GGCCGGCCAGGCAAAAAAGAAAAAGGGATCCTACCCATACGATGTTCCAGATTACG

CTTATCCCTACGACGTGCCTGATTATGCATACCCATATGATGTCCCCGACTATG

CCTAAGAATTC
```

9- Lachnospiraceae bacterium MA2020 (Lb2Cpf1)

(SEQ ID NO: 221)

```
ATGTACTATGAGTCCCTGACCAAGCAGTACCCCGTGTCTAAGACAATCCGGAATGAGCTGAT

CCCTATCGGCAAGACACTGGATAACATCCGCCAGAACAATATCCTGGAGAGCGACGTGAAG

CGGAAGCAGAACTACGAGCACGTGAAGGGCATCCTGGATGAGTATCACAAGCAGCTGATCA

ACGAGGCCCTGGACAATTGCACCCTGCCATCCCTGAAGATCGCCGCCGAGATCTACCTGAAG

AATCAGAAGGAGGTGTCTGACAGAGAGGATTTCAACAAGACACAGGACCTGCTGAGGAAGG

AGGTGGTGGAGAAGCTGAAGGCCCACGAGAACTTTACCAAGATCGGCAAGAAGGACATCCT

GGATCTGCTGGAGAAGCTGCCTTCCATCTCTGAGGACGATTACAATGCCCTGGAGAGCTTCC

GCAACTTTTACACCTATTTCACATCCTACAACAAGGTGCGGGAGAATCTGTATTCTGATAAG

GAGAAGAGCTCCACAGTGGCCTACAGACTGATCAACGAGAATTTCCCAAAGTTTCTGGACA

ATGTGAAGAGCTATAGGTTTGTGAAAACCGCAGGCATCCTGGCAGATGGCCTGGGAGAGGA

GGAGCAGGACTCCCTGTTCATCGTGGAGACATTCAACAAGACCCTGACACAGGACGGCATC

GATACCTACAATTCTCAAGTGGGCAAGATCAACTCTAGCATCAATCTGTATAACCAGAAGAA

TCAGAAGGCCAATGGCTTCAGAAAGATCCCCAAGATGAAGATGCTGTATAAGCAGATCCTG

TCCGATAGGGAGGAGTCTTTCATCGACGAGTTTCAGAGCGATGAGGTGCTGATCGACAACGT

GGAGTCTTATGGCAGCGTGCTGATCGAGTCTCTGAAGTCCTCTAAGGTGAGCGCCTTCTTTG

ATGCCCTGAGAGAGTCTAAGGGCAAGAACGTGTACGTGAAGAATGACCTGGCCAAGACAGC

CATGAGCAACATCGTGTTCGAGAATTGGAGGACCTTTGACGATCTGCTGAACCAGGAGTACG

ACCTGGCCAACGAGAACAAGAAGAAGGACGATAAGTATTTCGAGAAGCGCCAGAAGGAGC

TGAAGAAGAATAAGAGCTACTCCCTGGAGCACCTGTGCAACCTGTCCGAGGATTCTTGTAAC

CTGATCGAGAATTATATCCACCAGATCTCCGACGATATCGAGAATATCATCATCAACAATGA
```

```
GACATTCCTGCGCATCGTGATCAATGAGCACGACAGGTCCCGCAAGCTGGCCAAGAACCGG
AAGGCCGTGAAGGCCATCAAGGACTTTCTGGATTCTATCAAGGTGCTGGAGCGGGAGCTGA
AGCTGATCAACAGCTCCGGCCAGGAGCTGGAGAAGGATCTGATCGTGTACTCTGCCCACGA
GGAGCTGCTGGTGGAGCTGAAGCAGGTGGACAGCCTGTATAACATGACCAGAAATTATCTG
ACAAAGAAGCCTTTCTCTACCGAGAAGGTGAAGCTGAACTTTAATCGCAGCACACTGCTGAA
CGGCTGGGATCGGAATAAGGAGACAGACAACCTGGGCGTGCTGCTGCTGAAGGACGGCAAG
TACTATCTGGGCATCATGAACACAAGCGCCAATAAGGCCTTCGTGAATCCCCCTGTGGCCAA
GACCGAGAAGGTGTTTAAGAAGGTGGATTACAAGCTGCTGCCAGTGCCCAACCAGATGCTG
CCAAAGGTGTTCTTTGCCAAGAGCAATATCGACTTCTATAACCCCTCTAGCGAGATCTACTC
CAATTATAAGAAGGGCACCCACAAGAAGGGCAATATGTTTTCCCTGGAGGATTGTCACAAC
CTGATCGACTTCTTTAAGGAGTCTATCAGCAAGCACGAGGACTGGAGCAAGTTCGGCTTTAA
GTTCAGCGATACAGCCTCCTACAACGACATCTCCGAGTTCTATCGCGAGGTGGAGAAGCAGG
GCTACAAGCTGACCTATACAGACATCGATGAGACATACATCAATGATCTGATCGAGCGGAA
CGAGCTGTACCTGTTCCAGATCTATAATAAGGACTTTAGCATGTACTCCAAGGGCAAGCTGA
ACCTGCACACACTGTATTTCATGATGCTGTTTGATCAGCGCAATATCGACGACGTGGTGTAT
AAGCTGAACGGAGAGGCAGAGGTGTTCTATAGGCCAGCCTCCATCTCTGAGGACGAGCTGA
TCATCCACAAGGCCGGCGAGGAGATCAAGAACAAGAATCCTAACCGGGCCAGAACCAAGG
AGACAAGCACCTTCAGCTACGACATCGTGAAGGATAAGCGGTATAGCAAGGATAAGTTTAC
CCTGCACATCCCCATCACAATGAACTTCGGCGTGGATGAGGTGAAGCGGTTCAACGACGCCG
TGAACAGCGCCATCCGGATCGATGAGAATGTGAACGTGATCGGCATCGACCGGGGCGAGAG
AAATCTGCTGTACGTGGTGGTCATCGACTCTAAGGGCAACATCCTGGAGCAGATCTCCCTGA
ACTCTATCATCAATAAGGAGTACGACATCGAGACAGATTATCACGCACTGCTGGATGAGAG
GGAGGGCGGCAGAGATAAGGCCCGGAAGGACTGGAACACCGTGGAGAATATCAGGGACCT
GAAGGCCGGCTACCTGAGCCAGGTGGTGAACGTGGTGGCCAAGCTGGTGCTGAAGTATAAT
GCCATCATCTGCCTGGAGGACCTGAACTTTGGCTTCAAGAGGGGCCGCCAGAAGGTGGAGA
AGCAGGTGTACCAGAAGTTCGAGAAGATGCTGATCGATAAGCTGAATTACCTGGTCATCGA
CAAGAGCCGCGAGCAGACATCCCCTAAGGAGCTGGGAGGCGCCCTGAACGCACTGCAGCTG
ACCTCTAAGTTCAAGAGCTTTAAGGAGCTGGGCAAGCAGTCCGGCGTGATCTACTATGTGCC
TGCCTACCTGACCTCTAAGATCGATCCAACCACAGGCTTCGCCAATCTGTTTTATATGAAGTG
TGAGAACGTGGAGAAGTCCAAGAGATTCTTTGACGGCTTTGATTTCATCAGGTTCAACGCCC
TGGAGAACGTGTTCGAGTTCGGCTTTGACTACCGGAGCTTCACCCAGAGGGCCTGCGGCATC
AATTCCAAGTGGACCGTGTGCACCAACGGCGAGCGCATCATCAAGTATCGGAATCCAGATA
AGAACAATATGTTCGACGAGAAGGTGGTGGTGGTGACCGATGAGATGAAGAACCTGTTTGA
GCAGTACAAGATCCCCTATGAGGATGGCAGAAATGTGAAGGACATGATCATCAGCAACGAG
GAGGCCGAGTTCTACCGGAGACTGTATAGGCTGCTGCAGCAGACCCTGCAGATGAGAAACA
GCACCTCCGACGGCACAAGGGATTACATCATCTCCCCTGTGAAGAATAAGAGAGAGGCCTA
CTTCAACAGCGAGCTGTCCGACGGCTCTGTGCCAAAGGACGCCGATGCCAACGGCGCCTAC
AATATCGCCAGAAAGGGCCTGTGGGTGCTGGAGCAGATCAGGCAGAAGAGCGAGGGCGAG
AAGATCAATCTGGCCATGACCAACGCCGAGTGGCTGGAGTATGCCCAGACACACCTGCTGAA
*AAGGCCGGCGGCCACGAAAAAGGCCGGCCAGGCAAAAAAGAAAAAG*GGATCCTACCCATACGA
```

-continued

```
TGTTCCAGATTACGCTTATCCCTACGACGTGCCTGATTATGCATACCCATATGATGTCC

CCGACTATGCCTAAGAATTC
```

10- Candidatus Methanoplasma termitum (CMtCpf1)

(SEQ ID NO: 222)

```
ATGAACAATTACGACGAGTTCACCAAGCTGTATCCTATCCAGAAAACCATCCGGTTTGAGCT

GAAGCCACAGGGCAGAACCATGGAGCACCTGGAGACATTCAACTTCTTTGAGGAGGACCGG

GATAGAGCCGAGAAGTATAAGATCCTGAAGGAGGCCATCGACGAGTACCACAAGAAGTTTA

TCGATGAGCACCTGACCAATATGTCCCTGGATTGGAACTCTCTGAAGCAGATCAGCGAGAAG

TACTATAAGAGCAGGGAGGAGAAGGACAAGAAGGTGTTCCTGTCCGAGCAGAAGAGGATG

CGCCAGGAGATCGTGTCTGAGTTTAAGAAGGACGATCGCTTCAAGGACCTGTTTTCCAAGAA

GCTGTTCTCTGAGCTGCTGAAGGAGGAGATCTACAAGAAGGGCAACCACCAGGAGATCGAC

GCCCTGAAGAGCTTCGATAAGTTTTCCGGCTATTTCATCGGCCTGCACGAGAATAGGAAGAA

CATGTACTCCGACGGCGATGAGATCACCGCCATCTCCAATCGCATCGTGAATGAGAACTTCC

CCAAGTTTCTGGATAACCTGCAGAAGTACCAGGAGGCCAGGAAGAAGTATCCTGAGTGGAT

CATCAAGGCCGAGAGCGCCCTGGTGGCCCACAATATCAAGATGGACGAGGTGTTCTCCCTG

GAGTACTTTAATAAGGTGCTGAACCAGGAGGGCATCCAGCGGTACAACCTGGCCCTGGGCG

GCTATGTGACCAAGAGCGGCGAGAAGATGATGGGCCTGAATGATGCCCTGAACCTGGCCCA

CCAGTCCGAGAAGAGCTCCAAGGGCAGAATCCACATGACCCCCCCTGTTCAAGCAGATCCTGT

CCGAGAAGGAGTCCTTCTCTTACATCCCCGACGTGTTTACAGAGGATTCTCAGCTGCTGCCT

AGCATCGGCGGCTTCTTTGCCCAGATCGAGAATGACAAGGATGGCAACATCTTCGACCGGGC

CCTGGAGCTGATCTCTAGCTACGCCGAGTATGATACCGAGCGGATCTATATCAGACAGGCCG

ACATCAATAGAGTGTCCAACGTGATCTTTGGAGAGTGGGGCACCCTGGGAGGCCTGATGAG

GGAGTACAAGGCCGACTCTATCAATGATATCAACCTGGAGCGCACATGCAAGAAGGTGGAC

AAGTGGCTGGATTCTAAGGAGTTTGCCCTGAGCGATGTGCTGGAGGCCATCAAGAGGACCG

GCAACAATGACGCCTTCAACGAGTATATCTCCAAGATGCGGACAGCCAGAGAGAAGATCGA

TGCCGCCCGCAAGGAGATGAAGTTCATCAGCGAGAAGATCTCCGGCGATGAGGAGTCTATC

CACATCATCAAGACCCTGCTGGACAGCGTGCAGCAGTTCCTGCACTTCTTTAATCTGTTTAAG

GCAAGGCAGGACATCCCACTGGATGGAGCCTTCTACGCCGAGTTTGACGAGGTGCACAGCA

AGCTGTTTGCCATCGTGCCCCTGTATAACAAGGTGCGGAACTATCTGACCAAGAACAATCTG

AACACAAAGAAGATCAAGCTGAATTTCAAGAACCCTACACTGGCCAATGGCTGGGACCAGA

ACAAGGTGTACGATTATGCCTCCCTGATCTTTCTGCGGGACGGCAATTACTATCTGGGCATC

ATCAATCCTAAGAGAAAGAAGAACATCAAGTTCGAGCAGGGCTCTGGCAACGGCCCCTTCT

ACCGGAAGATGGTGTATAAGCAGATCCCCGGCCCTAATAAGAACCTGCCAAGAGTGTTCCT

GACCTCCACAAAGGGCAAGAAGGAGTATAAGCCCTCTAAGGAGATCATCGAGGGCTACGAG

GCCGACAAGCACATCAGGGGCGATAAGTTCGACCTGGATTTTTGTCACAAGCTGATCGATTT

CTTTAAGGAGTCCATCGAGAAGCACAAGGACTGGTCTAAGTTCAACTTCTACTTCAGCCCAA

CCGAGAGCTATGGCGACATCTCTGAGTTCTACCTGGATGTGGAGAAGCAGGGCTATCGCATG

CACTTTGAGAATATCAGCGCCGAGACAATCGACGAGTATGTGGAGAAGGGCGATCTGTTTCT

GTTCCAGATCTACAACAAGGATTTTGTGAAGGCCGCCACCGGCAAGAAGGACATGCACACA

ATCTACTGGAATGCCGCCTTCAGCCCCGAGAACCTGCAGGACGTGGTGGTGAAGCTGAACG

GCGAGGCCGAGCTGTTTTATAGGGACAAGTCCGATATCAAGGAGATCGTGCACCGCGAGGG

CGAGATCCTGGTGAATAGGACCTACAACGGCCGCACACCAGTGCCCGACAAGATCCACAAG
```

-continued

AAGCTGACCGATTATCACAATGGCCGGACAAAGGACCTGGGCGAGGCCAAGGAGTACCTGG
ATAAGGTGAGATACTTCAAGGCCCACTATGACATCACCAAGGATCGGAGATACCTGAACGA
CAAGATCTATTTCCACGTGCCTCTGACCCTGAACTTCAAGGCCAACGGCAAGAAGAATCTGA
ACAAGATGGTCATCGAGAAGTTCCTGTCCGATGAGAAGGCCCACATCATCGGCATCGACAG
GGGCGAGCGCAATCTGCTGTACTATTCCATCATCGACAGGTCTGGCAAGATCATCGATCAGC
AGAGCCTGAATGTGATCGACGGCTTTGATTATCGGGAGAAGCTGAACCAGAGAGAGATCGA
GATGAAGGATGCCCGCCAGTCTTGGAACGCCATCGGCAAGATCAAGGACCTGAAGGAGGGC
TACCTGAGCAAGGCCGTGCACGAGATCACCAAGATGGCCATCCAGTATAATGCCATCGTGGT
CATGGAGGAGCTGAACTACGGCTTCAAGCGGGGCCGGTTCAAGGTGGAGAAGCAGATCTAT
CAGAAGTTCGAGAATATGCTGATCGATAAGATGAACTACCTGGTGTTTAAGGACGCACCTGA
TGAGTCCCCAGGAGGCGTGCTGAATGCCTACCAGCTGACAAACCCACTGGAGTCTTTCGCCA
AGCTGGGCAAGCAGACCGGCATCCTGTTTTACGTGCCAGCCGCCTATACATCCAAGATCGAC
CCCACCACAGGCTTCGTGAATCTGTTTAACACCTCCTCTAAGACAAACGCCCAGGAGCGGAA
GGAGTTCCTGCAGAAGTTTGAGAGCATCTCCTATTCTGCCAAGGATGGCGGCATCTTTGCCT
TCGCCTTTGACTACAGAAAGTTCGGCACCAGCAAGACAGATCACAAGAACGTGTGGACCGC
CTATACAAACGGCGAGAGGATGCGCTACATCAAGGAGAAGAAGCGGAATGAGCTGTTTGAC
CCTTCTAAGGAGATCAAGGAGGCCCTGACCAGCTCCGGCATCAAGTACGATGGCGGCCAGA
ACATCCTGCCAGACATCCTGAGGAGCAACAATAACGGCCTGATCTACACAATGTATTCTAGC
TTCATCGCCGCCATCCAGATGCGCGTGTACGACGGCAAGGAGGATTATATCATCAGCCCCAT
CAAGAACTCCAAGGGCGAGTTCTTTAGGACCGACCCCAAGAGGCGCGAGCTGCCTATCGAC
GCCGATGCCAATGGCGCCTACAACATCGCCCTGAGGGGAGAGCTGACAATGAGGGCAATCG
CAGAGAAGTTCGACCCTGATAGCGAGAAGATGGCCAAGCTGGAGCTGAAGCACAAGGATTG
GTTCGAGTTTATGCAGACCAGAGGCGAC*AAAAGGCCGGCGGCCACGAAAAAGGCCGGCCAGG*
*CAAAAAAGAAAAAG*GGATCCTACCCATACGATGTTCCAGATTACGCTTATCCCTACGACGT
GCCTGATTATGCATACCCATATGATGTCCCCGACTATGCCTAAGAATTC

11- Eubacterium eligens (EeCpf1)

(SEQ ID NO: 223)

ATGAACGGCAATAGGTCCATCGTGTACCGCGAGTTCGTGGGCGTGATCCCCGTGGCCAAGAC
CCTGAGGAATGAGCTGCGCCCTGTGGGCCACACACAGGAGCACATCATCCAGAACGGCCTG
ATCCAGGAGGACGAGCTGCGGCAGGAGAAGAGCACCGAGCTGAAGAACATCATGGACGAT
TACTATAGAGAGTACATCGATAAGTCTCTGAGCGGCGTGACCGACCTGGACTTCACCCTGCT
GTTCGAGCTGATGAACCTGGTGCAGAGCTCCCCCTCCAAGGACAATAAGAAGGCCCTGGAG
AAGGAGCAGTCTAAGATGAGGGAGCAGATCTGCACCCACCTGCAGTCCGACTCTAACTACA
AGAATATCTTTAACGCCAAGCTGCTGAAGGAGATCCTGCCTGATTTCATCAAGAACTACAAT
CAGTATGACGTGAAGGATAAGGCCGGCAAGCTGGAGACACTGGCCCTGTTTAATGGCTTCA
GCACATACTTTACCGACTTCTTTGAAGAGAGGAAGAACGTGTTCACCAAGGAGGCCGTGAG
CACATCCATCGCCTACCGCATCGTGCACGAGAACTCCCTGATCTTCCTGGCCAATATGACCT
CTTATAAGAAGATCAGCGAGAAGGCCCTGGATGAGATCGAAGTGATCGAGAAGAACAATCA
GGACAAGATGGGCGATTGGGAGCTGAATCAGATCTTTAACCCTGACTTCTACAATATGGTGC
TGATCCAGTCCGGCATCGACTTCTACAACGAGATCTGCGGCGTGGTGAATGCCCACATGAAC
CTGTACTGTCAGCAGACCAAGAACAATTATAACCTGTTCAAGATGCGGAAGCTGCACAAGC
AGATCCTGGCCTACACCAGCACCAGCTTCGAGGTGCCCAAGATGTTCGAGGACGATATGAG

-continued

```
CGTGTATAACGCCGTGAACGCCTTCATCGACGAGACAGAGAAGGGCAACATCATCGGCAAG

CTGAAGGATATCGTGAATAAGTACGACGAGCTGGATGAGAAGAGAATCTATATCAGCAAGG

ACTTTTACGAGACACTGAGCTGCTTCATGTCCGGCAACTGGAATCTGATCACAGGCTGCGTG

GAGAACTTCTACGATGAGAACATCCACGCCAAGGGCAAGTCCAAGGAGGAGAAGGTGAAG

AAGGCCGTGAAGGAGGACAAGTACAAGTCTATCAATGACGTGAACGATCTGGTGGAGAAGT

ATATCGATGAGAAGGAGAGGAATGAGTTCAAGAACAGCAATGCCAAGCAGTACATCCGCGA

GATCTCCAACATCATCACCGACACAGAGACAGCCCACCTGGAGTATGACGATCACATCTCTC

TGATCGAGAGCGAGGAGAAGGCCGACGAGATGAAGAAGCGGCTGGATATGTATATGAACAT

GTACCACTGGGCCAAGGCCTTTATCGTGGACGAGGTGCTGGACAGAGATGAGATGTTCTACA

GCGATATCGACGATATCTATAATATCCTGGAGAACATCGTGCCACTGTATAATCGGGTGAGA

AACTACGTGACCCAGAAGCCCTACAACTCTAAGAAGATCAAGCTGAATTTCCAGAGCCCTAC

ACTGGCCAATGGCTGGTCCCAGTCTAAGGAGTTCGACAACAATGCCATCATCCTGATCAGAG

ATAACAAGTACTATCTGGCCATCTTCAATGCCAAGAACAAGCCAGACAAGAAGATCATCCA

GGGCAACTCCGATAAGAAGAACGACAACGATTACAAGAAGATGGTGTATAACCTGCTGCCA

GGCGCCAACAAGATGCTGCCCAAGGTGTTTCTGTCTAAGAAGGGCATCGAGACATTCAAGC

CCTCCGACTATATCATCTCTGGCTACAACGCCCACAAGCACATCAAGACAAGCGAGAATTTT

GATATCTCCTTCTGTCGGGACCTGATCGATTACTTCAAGAACAGCATCGAGAAGCACGCCGA

GTGGAGAAAGTATGAGTTCAAGTTTTCCGCCACCGACAGCTACTCCGATATCTCTGAGTTCT

ATCGGGAGGTGGAGATGCAGGGCTACAGAATCGACTGGACATATATCAGCGAGGCCGACAT

CAACAAGCTGGATGAGGAGGGCAAGATCTATCTGTTTCAGATCTACAATAAGGATTTCGCCG

AGAACAGCACCGGCAAGGAGAATCTGCACACAATGTACTTTAAGAACATCTTCTCCGAGGA

GAATCTGAAGGACATCATCATCAAGCTGAACGGCCAGGCCGAGCTGTTTTATCGGAGAGCCT

CTGTGAAGAATCCCGTGAAGCACAAGAAGGATAGCGTGCTGGTGAACAAGACCTACAAGAA

TCAGCTGGACAACGGCGACGTGGTGAGAATCCCCATCCCTGACGATATCTATAACGAGATCT

ACAAGATGTATAATGGCTACATCAAGGAGTCCGACCTGTCTGAGGCCGCCAAGGAGTACCT

GGATAAGGTGGAGGTGAGGACCGCCCAGAAGGACATCGTGAAGGATTACCGCTATACAGTG

GACAAGTACTTCATCCACACACCTATCACCATCAACTATAAGGTGACCGCCCGCAACAATGT

GAATGATATGGTGGTGAAGTACATCGCCCAGAACGACGATATCCACGTGATCGGCATCGAC

CGGGGCGAGAGAAACCTGATCTACATCTCCGTGATCGATTCTCACGGCAACATCGTGAAGCA

GAAATCCTACAACATCCTGAACAACTACGACTACAAGAAGAAGCTGGTGGAGAAGGAGAAA

ACCCGGGAGTACGCCAGAAAGAACTGGAAGAGCATCGGCAATATCAAGGAGCTGAAGGAG

GGCTATATCTCCGGCGTGGTGCACGAGATCGCCATGCTGATCGTGGAGTACAACGCCATCAT

CGCCATGGAGGACCTGAATTATGGCTTTAAGAGGGGCCGCTTCAAGGTGGAGCGGCAGGTG

TACCAGAAGTTTGAGAGCATGCTGATCAATAAGCTGAACTATTTCGCCAGCAAGGAGAAGT

CCGTGGACGAGCCAGGAGGCCTGCTGAAGGGCTATCAGCTGACCTACGTGCCCGATAATAT

CAAGAACCTGGGCAAGCAGTGCGGCGTGATCTTTTACGTGCCTGCCGCCTTCACCAGCAAGA

TCGACCCATCCACAGGCTTTATCTCTGCCTTCAACTTTAAGTCTATCAGCACAAATGCCTCTC

GGAAGCAGTTCTTTATGCAGTTTGACGAGATCAGATACTGTGCCGAGAAGGATATGTTCAGC

TTTGGCTTCGACTACAACAACTTCGATACCTACAACATCACAATGGGCAAGACACAGTGGAC

CGTGTATACAAACGGCGAGAGACTGCAGTCTGAGTTCAACAATGCCAGGCGCACCGGCAAG

ACAAAGAGCATCAATCTGACAGAGACAATCAAGCTGCTGCTGGAGGACAATGAGATCAACT
```

-continued

```
ACGCCGACGGCCACGATATCAGGATCGATATGGAGAAGATGGACGAGGATAAGAAGAGCG

AGTTCTTTGCCCAGCTGCTGAGCCTGTATAAGCTGACCGTGCAGATGCGCAATTCCTATACA

GAGGCCGAGGAGCAGGAGAACGGCATCTCTTACGACAAGATCATCAGCCCTGTGATCAATG

ATGAGGGCGAGTTCTTTGACTCCGATAACTATAAGGAGTCTGACGATAAGGAGTGCAAGAT

GCCAAAGGACGCCGATGCCAACGGCGCCTACTGTATCGCCCTGAAGGGCCTGTATGAGGTG

CTGAAGATCAAGAGCGAGTGGACCGAGGACGGCTTTGATAGGAATTGCCTGAAGCTGCCAC

ACGCAGAGTGGCTGGACTTCATCCAGAACAAGCGGTACGAGAAAAGGCCGGCGGCCACGAAA

AAGGCCGGCCAGGCAAAAAAGAAAAAGGGATCCTACCCATACGATGTTCCAGATTACGCTTA

TCCCTACGACGTGCCTGATTATGCATACCCATATGATGTCCCCGACTATGCCTAAGAAT

TC
```

12- Moraxella bovoculi 237 (MbCpf1)

(SEQ ID NO: 224)

```
ATGCTGTTCCAGGACTTTACCCACCTGTATCCACTGTCCAAGACAGTGAGATTTGAGCTGAA

GCCCATCGATAGGACCCTGGAGCACATCCACGCCAAGAACTTCCTGTCTCAGGACGAGACA

ATGGCCGATATGCACCAGAAGGTGAAAGTGATCCTGGACGATTACCACCGCGACTTCATCGC

CGATATGATGGGCGAGGTGAAGCTGACCAAGCTGGCCGAGTTCTATGACGTGTACCTGAAG

TTTCGGAAGAACCCAAAGGACGATGAGCTGCAGAAGCAGCTGAAGGATCTGCAGGCCGTGC

TGAGAAAGGAGATCGTGAAGCCCATCGGCAATGGCGGCAAGTATAAGGCCGGCTACGACAG

GCTGTTCGGCGCCAAGCTGTTTAAGGACGGCAAGGAGCTGGGCGATCTGGCCAAGTTCGTG

ATCGCACAGGAGGGAGAGAGCTCCCCAAAGCTGGCCCACCTGGCCCACTTCGAGAAGTTTT

CCACCTATTTCACAGGCTTTCACGATAACCGGAAGAATATGTATTCTGACGAGGATAAGCAC

ACCGCCATCGCCTACCGCCTGATCCACGAGAACCTGCCCCGGTTTATCGACAATCTGCAGAT

CCTGACCACAATCAAGCAGAAGCACTCTGCCCTGTACGATCAGATCATCAACGAGCTGACCG

CCAGCGGCCTGGACGTGTCTCTGGCCAGCCACCTGGATGGCTATCACAAGCTGCTGACACAG

GAGGGCATCACCGCCTACAATACACTGCTGGGAGGAATCTCCGGAGAGGCAGGCTCTCCTA

AGATCCAGGGCATCAACGAGCTGATCAATTCTCACCACAACCAGCACTGCCACAAGAGCGA

GAGAATCGCCAAGCTGAGGCCACTGCACAAGCAGATCCTGTCCGACGGCATGAGCGTGTCC

TTCCTGCCCTCTAAGTTTGCCGACGATAGCGAGATGTGCCAGGCCGTGAACGAGTTCTATCG

CCACTACGCCGACGTGTTCGCCAAGGTGCAGAGCCTGTTCGACGGCTTTGACGATCACCAGA

AGGATGGCATCTACGTGGAGCACAAGAACCTGAATGAGCTGTCCAAGCAGGCCTTCGGCGA

CTTTGCACTGCTGGGACGCGTGCTGGACGGATACTATGTGGATGTGGTGAATCCAGAGTTCA

ACGAGCGGTTTGCCAAGGCCAAGACCGACAATGCCAAGGCCAAGCTGACAAAGGAGAAGG

ATAAGTTCATCAAGGGCGTGCACTCCCTGGCCTCTCTGGAGCAGGCCATCGAGCACTATACC

GCAAGGCACGACGATGAGAGCGTGCAGGCAGGCAAGCTGGGACAGTACTTCAAGCACGGCC

TGGCCGGAGTGGACAACCCCATCCAGAAGATCCACAACAATCACAGCACCATCAAGGGCTT

TCTGGAGAGGGAGCGCCCTGCAGGAGAGAGCCCTGCCAAAGATCAAGTCCGGCAAGAAT

CCTGAGATGACACAGCTGAGGCAGCTGAAGGAGCTGCTGGATAACGCCCTGAATGTGGCCC

ACTTCGCCAAGCTGCTGACCACAAAGACCACACTGGACAATCAGGATGGCAACTTCTATGGC

GAGTTTGGCGTGCTGTACGACGAGCTGGCCAAGATCCCCACCCTGTATAACAAGGTGAGAG

ATTACCTGAGCCAGAAGCCTTTCTCCACCGAGAAGTACAAGCTGAACTTTGGCAATCCAACA

CTGCTGAATGGCTGGGACCTGAACAAGGAGAAGGATAATTTCGGCGTGATCCTGCAGAAGG

ACGGCTGCTACTATCTGGCCCTGCTGGACAAGGCCCACAAGAAGGTGTTTGATAACGCCCCT
```

-continued

```
AATACAGGCAAGAGCATCTATCAGAAGATGATCTATAAGTACCTGGAGGTGAGGAAGCAGT

TCCCCAAGGTGTTCTTTTCCAAGGAGGCCATCGCCATCAACTACCACCCTTCTAAGGAGCTG

GTGGAGATCAAGGACAAGGGCCGGCAGAGATCCGACGATGAGCGCCTGAAGCTGTATCGGT

TTATCCTGGAGTGTCTGAAGATCCACCCTAAGTACGATAAGAAGTTCGAGGGCGCCATCGGC

GACATCCAGCTGTTTAAGAAGGATAAGAAGGGCAGAGAGGTGCCAATCAGCGAGAAGGAC

CTGTTCGATAAGATCAACGGCATCTTTTCTAGCAAGCCTAAGCTGGAGATGGAGGACTTCTT

TATCGGCGAGTTCAAGAGGTATAACCCAAGCCAGGACCTGGTGGATCAGTATAATATCTACA

AGAAGATCGACTCCAACGATAATCGCAAGAAGGAGAATTTCTACAACAATCACCCCAAGTT

TAAGAAGGATCTGGTGCGGTACTATTACGAGTCTATGTGCAAGCACGAGGAGTGGGAGGAG

AGCTTCGAGTTTTCCAAGAAGCTGCAGGACATCGGCTGTTACGTGGATGTGAACGAGCTGTT

TACCGAGATCGAGACACGGAGACTGAATTATAAGATCTCCTTCTGCAACATCAATGCCGACT

ACATCGATGAGCTGGTGGAGCAGGGCCAGCTGTATCTGTTCCAGATCTACAACAAGGACTTT

TCCCCAAAGGCCCACGGCAAGCCCAATCTGCACACCCTGTACTTCAAGGCCCTGTTTTCTGA

GGACAACCTGGCCGATCCTATCTATAAGCTGAATGGCGAGGCCCAGATCTTCTACAGAAAG

GCCTCCCTGGACATGAACGAGACAACAATCCACAGGGCCGGCGAGGTGCTGGAGAACAAGA

ATCCCGATAATCCTAAGAAGAGACAGTTCGTGTACGACATCATCAAGGATAAGAGGTACAC

ACAGGACAAGTTCATGCTGCACGTGCCAATCACCATGAACTTTGGCGTGCAGGGCATGACA

ATCAAGGAGTTCAATAAGAAGGTGAACCAGTCTATCCAGCAGTATGACGAGGTGAACGTGA

TCGGCATCGATCGGGCGAGAGACACCTGCTGTACCTGACCGTGATCAATAGCAAGGGCGA

GATCCTGGAGCAGTGTTCCCTGAACGACATCACCACAGCCTCTGCCAATGGCACACAGATGA

CCACACCTTACCACAAGATCCTGGATAAGAGGGAGATCGAGCGCCTGAACGCCCGGGTGGG

ATGGGGCGAGATCGAGACAATCAAGGAGCTGAAGTCTGGCTATCTGAGCCACGTGGTGCAC

CAGATCAGCCAGCTGATGCTGAAGTACAACGCCATCGTGGTGCTGGAGGACCTGAATTTCGG

CTTTAAGAGGGGCCGCTTTAAGGTGGAGAAGCAGATCTATCAGAACTTCGAGAATGCCCTG

ATCAAGAAGCTGAACCACCTGGTGCTGAAGGACAAGGCCGACGATGAGATCGGCTCTTACA

AGAATGCCCTGCAGCTGACCAACAATTTCACAGATCTGAAGAGCATCGGCAAGCAGACCGG

CTTCCTGTTTTATGTGCCCGCCTGGAACACCTCTAAGATCGACCCTGAGACAGGCTTTGTGGA

TCTGCTGAAGCCAAGATACGAGAACATCGCCCAGAGCCAGGCCTTCTTTGGCAAGTTCGACA

AGATCTGCTATAATGCCGACAAGGATTACTTCGAGTTTCACATCGACTACGCCAAGTTTACC

GATAAGGCCAAGAATAGCCGCCAGATCTGGACAATCTGTTCCCACGGCGACAAGCGGTACG

TGTACGATAAGACAGCCAACCAGAATAAGGGCGCCGCCAAGGGCATCAACGTGAATGATGA

GCTGAAGTCCCTGTTCGCCCGCCACCACATCAACGAGAAGCAGCCCAACCTGGTCATGGACA

TCTGCCAGAACAATGATAAGGAGTTTCACAAGTCTCTGATGTACCTGCTGAAAACCCTGCTG

GCCCTGCGGTACAGCAACGCCTCCTCTGACGAGGATTTCATCCTGTCCCCGTGGCAAACGA

CGAGGGCGTGTTCTTTAATAGCGCCCTGGCCGACGATACACAGCCTCAGAATGCCGATGCCA

ACGGCGCCTACCACATCGCCCTGAAGGGCCTGTGGCTGCTGAATGAGCTGAAGAACTCCGA

CGATCTGAACAAGGTGAAGCTGGCCATCGACAATCAGACCTGGCTGAATTTCGCCCAGAAC
```

-continued

AGGAAAAGGCCGGCGGCCACGAAAAAGGCCGGCCAGGCAAAAAAGAAAAAGGGATCCTACCCA

TACGATGTTCCAGATTACGCTTATCCCTACGACGTGCCTGATTATGCATACCCATATGA

TGTCCCCGACTATGCCTAAGAATTC

13- Leptospira inadai (LiCpf1)

(SEQ ID NO: 225)

ATGGAGGACTATTCCGGCTTTGTGAACATCTACTCTATCCAGAAAACCCTGAGGTTCGAGCT

GAAGCCAGTGGGCAAGACACTGGAGCACATCGAGAAGAAGGGCTTCCTGAAGAAGGACAA

GATCCGGGCCGAGGATTACAAGGCCGTGAAGAAGATCATCGATAAGTACCACAGAGCCTAT

ATCGAGGAGGTGTTTGATTCCGTGCTGCACCAGAAGAAGAAGGACAAGACCCGCTTTT

CTACACAGTTCATCAAGGAGATCAAGGAGTTCAGCGAGCTGTACTATAAGACCGAGAAGAA

CATCCCCGACAAGGAGAGGCTGGAGGCCCTGAGCGAGAAGCTGCGCAAGATGCTGGTGGGC

GCCTTTAAGGGCGAGTTCTCCGAGGAGGTGGCCGAGAAGTATAAGAACCTGTTTTCTAAGGA

GCTGATCAGGAATGAGATCGAGAAGTTCTGCGAGACAGACGAGGAGCGCAAGCAGGTGTCT

AACTTCAAGAGCTTCACCACATACTTTACCGGCTTCCACTCCAACAGGCAGAATATCTATTC

CGACGAGAAGAAGTCTACAGCCATCGGCTACCGCATCATCCACCAGAACCTGCCTAAGTTCC

TGGATAATCTGAAGATCATCGAGTCCATCCAGCGGCGGTTCAAGGACTTCCCATGGTCTGAT

CTGAAGAAGAACCTGAAGAAGATCGATAAGAATATCAAGCTGACCGAGTACTTCAGCATCG

ACGGCTTCGTGAACGTGCTGAATCAGAAGGGCATCGATGCCTACAACACAATCCTGGGCGG

CAAGTCCGAGGAGTCTGGCGAGAAGATCCAGGGCCTGAACGAGTACATCAATCTGTATCGG

CAGAAGAACAATATCGACAGAAAGAACCTGCCCAATGTGAAGATCCTGTTTAAGCAGATCC

TGGGCGATAGGGAGACAAAGAGCTTTATCCCTGAGGCCTTCCCAGACGATCAGTCCGTGCTG

AACTCTATCACAGAGTTCGCCAAGTACCTGAAGCTGGATAAGAAGAAGAAGAGCATCATCG

CCGAGCTGAAGAAGTTTCTGAGCTCCTTCAATCGCTACGAGCTGGACGGCATCTATCTGGCC

AACGATAATAGCCTGGCCTCTATCAGCACCTTCCTGTTTGACGATTGGTCCTTTATCAAGAAG

TCCGTGTCTTTCAAGTATGACGAGTCCGTGGGCGACCCCAAGAAGAAGATCAAGTCTCCCCT

GAAGTACGAGAAGGAGAAGGAGAAGTGGCTGAAGCAGAAGTACTATACAATCTCTTTCCTG

AACGATGCCATCGAGAGCTATTCCAAGTCTCAGGACGAGAAGAGGGTGAAGATCCGCCTGG

AGGCCTACTTTGCCGAGTTCAAGAGCAAGGACGATGCCAAGAAGCAGTTCGACCTGCTGGA

GAGGATCGAGGAGGCCTATGCCATCGTGGAGCCTCTGCTGGGAGCAGAGTACCCAAGGGAC

CGCAACCTGAAGGCCGATAAGAAGGAAGTGGGCAAGATCAAGGACTTCCTGGATAGCATCA

AGTCCCTGCAGTTCTTTCTGAAGCCTCTGCTGTCCGCCGAGATCTTTGACGAGAAGGATCTG

GGCTTCTACAATCAGCTGGAGGGCTACTATGAGGAGATCGATTCTATCGGCCACCTGTATAA

CAAGGTGCGGAATTATCTGACCGGCAAGATCTACAGCAAGGAGAAGTTTAAGCTGAACTTC

GAGAACAGCACCCTGCTGAAGGGCTGGGACGAGAACCGGGAGGTGGCCAATCTGTGCGTGA

TCTTCAGAGAGGACCAGAAGTACTATCTGGGCGTGATGGATAAGGAGAACAATACCATCCT

GTCCGACATCCCCAAGGTGAAGCCTAACGAGCTGTTTTACGAGAAGATGGTGTATAAGCTGA

TCCCCACACCTCACATGCAGCTGCCCCGGATCATCTTCTCTAGCGACAACCTGTCTATCTATA

ATCCTAGCAAGTCCATCCTGAAGATCAGAGAGGCCAAGAGCTTTAAGGAGGGCAAGAACTT

CAAGCTGAAGGACTGTCACAAGTTTATCGATTTCTACAAGGAGTCTATCAGCAAGAATGAGG

ACTGGAGCAGATTCGACTTCAAGTTCAGCAAGACCAGCAGCTACGAGAACATCAGCGAGTT

TTACCGGGAGGTGGAGAGACAGGGCTATAACCTGGACTTCAAGAAGGTGTCTAAGTTCTAC

ATCGACAGCCTGGTGGAGGATGGCAAGCTGTACCTGTTCCAGATCTATAACAAGGACTTTTC

-continued

```
TATCTTCAGCAAGGGCAAGCCCAATCTGCACACCATCTATTTTCGGTCCCTGTTCTCTAAGGA
GAACCTGAAGGACGTGTGCCTGAAGCTGAATGGCGAGGCCGAGATGTTCTTTCGGAAGAAG
TCCATCAACTACGATGAGAAGAAGAAGCGGGAGGGCCACCACCCCGAGCTGTTTGAGAAGC
TGAAGTATCCTATCCTGAAGGACAAGAGATACAGCGAGGATAAGTTTCAGTTCCACCTGCCC
ATCAGCCTGAACTTCAAGTCCAAGGAGCGGCTGAACTTTAATCTGAAAGTGAATGAGTTCCT
GAAGAGAAACAAGGACATCAATATCATCGGCATCGATCGGGGCGAGAGAAACCTGCTGTAC
CTGGTCATGATCAATCAGAAGGGCGAGATCCTGAAGCAGACCCTGCTGGACAGCATGCAGT
CCGGCAAGGGCCGGCCTGAGATCAACTACAAGGAGAAGCTGCAGGAGAAGGAGATCGAGA
GGGATAAGGCCCGCAAGAGCTGGGGCACAGTGGAGAATATCAAGGAGCTGAAGGAGGGCT
ATCTGTCTATCGTGATCCACCAGATCAGCAAGCTGATGGTGGAGAACAATGCCATCGTGGTG
CTGGAGGACCTGAACATCGGCTTTAAGCGGGGCAGACAGAAGGTGGAGCGGCAGGTGTACC
AGAAGTTCGAGAAGATGCTGATCGATAAGCTGAACTTTCTGGTGTTCAAGGAGAATAAGCC
AACCGAGCCAGGAGGCGTGCTGAAGGCCTATCAGCTGACAGACGAGTTTCAGTCTTTCGAG
AAGCTGAGCAAGCAGACCGGCTTTCTGTTCTACGTGCCAAGCTGGAACACCTCCAAGATCGA
CCCCAGAACAGGCTTTATCGATTTCCTGCACCCTGCCTACGAGAATATCGAGAAGGCCAAGC
AGTGGATCAACAAGTTTGATTCCATCAGGTTCAATTCTAAGATGGACTGGTTTGAGTTCACC
GCCGATACACGCAAGTTTTCCGAGAACCTGATGCTGGGCAAGAATCGGGTGTGGGTCATCTG
CACCACAAATGTGGAGCGGTACTTCACCAGCAAGACCGCCAACAGCTCCATCCAGTACAAT
AGCATCCAGATCACCGAGAAGCTGAAGGAGCTGTTTGTGGACATCCCTTTCAGCAACGGCCA
GGATCTGAAGCCAGAGATCCTGAGGAAGAATGACGCCGTGTTCTTTAAGAGCCTGCTGTTTT
ACATCAAGACCACACTGTCCCTGCGCCAGAACAATGGCAAGAAGGGCGAGGAGGAGAAGG
ACTTCATCCTGAGCCCAGTGGTGGATTCCAAGGGCCGGTTCTTTAACTCTCTGGAGGCCAGC
GACGATGAGCCCAAGGACGCCGATGCCAATGGCGCCTACCACATCGCCCTGAAGGGCCTGA
TGAACCTGCTGGTGCTGAATGAGACAAAGGAGGAGAACCTGAGCAGACCAAAGTGGAAGAT
CAAGAATAAGGACTGGCTGGAGTTCGTGTGGGAGAGGAACCGCAAAAGGCCGGCGGCCACG
AAAAAGGCCGGCCAGGCAAAAAAGAAAAAGGGATCCTACCCATACGATGTTCCAGATTACGC
TTATCCCTACGACGTGCCTGATTATGCATACCCATATGATGTCCCCGACTATGCCTAAG
AATTC
```

14- Lachnospiraceae bacterium ND2006 (LbCpf1)

(SEQ ID NO: 226)
```
ATGAGCAAGCTGGAGAAGTTTACAAACTGCTACTCCCTGTCTAAGACCCTGAGGTTCAAGGC
CATCCCTGTGGGCAAGACCCAGGAGAACATCGACAATAAGCGGCTGCTGGTGGAGGACGAG
AAGAGAGCCGAGGATTATAAGGGCGTGAAGAAGCTGCTGGATCGCTACTATCTGTCTTTTAT
CAACGACGTGCTGCACAGCATCAAGCTGAAGAATCTGAACAATTACATCAGCCTGTTCCGGA
AGAAAACCAGAACCGAGAAGGAGAATAAGGAGCTGGAGAACCTGGAGATCAATCTGCGGA
AGGAGATCGCCAAGGCCTTCAAGGGCAACGAGGGCTACAAGTCCCTGTTTAAGAAGGATAT
CATCGAGACAATCCTGCCAGAGTTCCTGGACGATAAGGACGAGATCGCCCTGGTGAACAGC
TTCAATGGCTTTACCACAGCCTTCACCGGCTTCTTTGATAACAGAGAGAATATGTTTTCCGAG
GAGGCCAAGAGCACATCCATCGCCTTCAGGTGTATCAACGAGAATCTGACCCGCTACATCTC
TAATATGGACATCTTCGAGAAGGTGGACGCCATCTTTGATAAGCACGAGGTGCAGGAGATC
AAGGAGAAGATCCTGAACAGCGACTATGATGTGGAGGATTTCTTTGAGGGCGAGTTCTTTAA
CTTTGTGCTGACACAGGAGGGCATCGACGTGTATAACGCCATCATCGGCGGCTTCGTGACCG
```

-continued

```
AGAGCGGCGAGAAGATCAAGGGCCTGAACGAGTACATCAACCTGTATAATCAGAAAACCAA

GCAGAAGCTGCCTAAGTTTAAGCCACTGTATAAGCAGGTGCTGAGCGATCGGGAGTCTCTGA

GCTTCTACGGCGAGGGCTATACATCCGATGAGGAGGTGCTGGAGGTGTTTAGAAACACCCTG

AACAAGAACAGCGAGATCTTCAGCTCCATCAAGAAGCTGGAGAAGCTGTTCAAGAATTTTG

ACGAGTACTCTAGCGCCGGCATCTTTGTGAAGAACGGCCCCGCCATCAGCACAATCTCCAAG

GATATCTTCGGCGAGTGGAACGTGATCCGGGACAAGTGGAATGCCGAGTATGACGATATCC

ACCTGAAGAAGAAGGCCGTGGTGACCGAGAAGTACGAGGACGATCGGAGAAAGTCCTTCAA

GAAGATCGGCTCCTTTTCTCTGGAGCAGCTGCAGGAGTACGCCGACGCCGATCTGTCTGTGG

TGGAGAAGCTGAAGGAGATCATCATCCAGAAGGTGGATGAGATCTACAAGGTGTATGGCTC

CTCTGAGAAGCTGTTCGACGCCGATTTTGTGCTGGAAGAGCCTGAAGAAGAACGACGCC

GTGGTGGCCATCATGAAGGACCTGCTGGATTCTGTGAAGAGCTTCGAGAATTACATCAAGGC

CTTCTTTGGCGAGGGCAAGGAGACAAACAGGGACGAGTCCTTCTATGGCGATTTTGTGCTGG

CCTACGACATCCTGCTGAAGGTGGACCACATCTACGATGCCATCCGCAATTATGTGACCCAG

AAGCCCTACTCTAAGGATAAGTTCAAGCTGTATTTTCAGAACCCTCAGTTCATGGGCGGCTG

GGACAAGGATAAGGAGACAGACTATCGGGCCACCATCCTGAGATACGGCTCCAAGTACTAT

CTGGCCATCATGGATAAGAAGTACGCCAAGTGCCTGCAGAAGATCGACAAGGACGATGTGA

ACGGCAATTACGAGAAGATCAACTATAAGCTGCTGCCCGGCCCTAATAAGATGCTGCCAAA

GGTGTTCTTTTCTAAGAAGTGGATGGCCTACTATAACCCCAGCGAGGACATCCAGAAGATCT

ACAAGAATGGCACATTCAAGAAGGGCGATATGTTTAACCTGAATGACTGTCACAAGCTGAT

CGACTTCTTTAAGGATAGCATCTCCCGGTATCCAAAGTGGTCCAATGCCTACGATTTCAACTT

TTCTGAGACAGAGAAGTATAAGGACATCGCCGGCTTTTACAGAGAGGTGGAGGAGCAGGGC

TATAAGGTGAGCTTCGAGTCTGCCAGCAAGAAGGAGGTGGATAAGCTGGTGGAGGAGGGCA

AGCTGTATATGTTCCAGATCTATAACAAGGACTTTTCCGATAAGTCTCACGGCACACCCAAT

CTGCACACCATGTACTTCAAGCTGCTGTTTGACGAGAACAATCACGGACAGATCAGGCTGAG

CGGAGGAGCAGAGCTGTTCATGAGGCGCGCCTCCCTGAAGAAGGAGGAGCTGGTGGTGCAC

CCAGCCAACTCCCCTATCGCCAACAAGAATCCAGATAATCCCAAGAAAACCACAACCCTGTC

CTACGACGTGTATAAGGATAAGAGGTTTTCTGAGGACCAGTACGAGCTGCACATCCCAATCG

CCATCAATAAGTGCCCCAAGAACATCTTCAAGATCAATACAGAGGTGCGCGTGCTGCTGAA

GCACGACGATAACCCCTATGTGATCGGCATCGATAGGGGCGAGCGCAATCTGCTGTATATCG

TGGTGGTGGACGGCAAGGGCAACATCGTGGAGCAGTATTCCCTGAACGAGATCATCAACAA

CTTCAACGGCATCAGGATCAAGACAGATTACCACTCTCTGCTGGACAAGAAGGAGAAGGAG

AGGTTCGAGGCCCGCCAGAACTGGACCTCCATCGAGAATATCAAGGAGCTGAAGGCCGGCT

ATATCTCTCAGGTGGTGCACAAGATCTGCGAGCTGGTGGAGAAGTACGATGCCGTGATCGCC

CTGGAGGACCTGAACTCTGGCTTTAAGAATAGCCGCGTGAAGGTGGAGAAGCAGGTGTATC

AGAAGTTCGAGAAGATGCTGATCGATAAGCTGAACTACATGGTGGACAAGAAGTCTAATCC

TTGTGCAACAGGCGGCGCCCTGAAGGGCTATCAGATCACCAATAAGTTCGAGAGCTTTAAGT

CCATGTCTACCCAGAACGGCTTCATCTTTTACATCCCTGCCTGGCTGACATCCAAGATCGATC

CATCTACCGGCTTTGTGAACCTGCTGAAAACCAAGTATACCAGCATCGCCGATTCCAAGAAG

TTCATCAGCTCCTTTGACAGGATCATGTACGTGCCCGAGGAGGATCTGTTCGAGTTTGCCCTG

GACTATAAGAACTTCTCTCGCACAGACGCCGATTACATCAAGAAGTGGAAGCTGTACTCCTA
```

-continued

CGGCAACCGGATCAGAATCTTCCGGAATCCTAAGAAGAACAACGTGTTCGACTGGGAGGAG

GTGTGCCTGACCAGCGCCTATAAGGAGCTGTTCAACAAGTACGGCATCAATTATCAGCAGGG

CGATATCAGAGCCCTGCTGTGCGAGCAGTCCGACAAGGCCTTCTACTCTAGCTTTATGGCCC

TGATGAGCCTGATGCTGCAGATGCGGAACAGCATCACAGGCCGCACCGACGTGGATTTTCTG

ATCAGCCCTGTGAAGAACTCCGACGGCATCTTCTACGATAGCCGGAACTATGAGGCCCAGG

AGAATGCCATCCTGCCAAAGAACGCCGACGCCAATGGCGCCTATAACATCGCCAGAAAGGT

GCTGTGGGCCATCGGCCAGTTCAAGAAGGCCGAGGACGAGAAGCTGGATAAGGTGAAGATC

GCCATCTCTAACAAGGAGTGGCTGGAGTACGCCCAGACCAGCGTGAAGCACAAAAGGCCGG

CGGCCACGAAAAAGGCCGGCCAGGCAAAAAAGAAAAAGGGATCCTACCCATACGATGTTCCA

GATTACGCTTATCCCTACGACGTGCCTGATTATGCATACCCATATGATGTCCCCGACTA

TGCCTAAGAATTC

15- Porphyromonas crevioricanis (PcCpfl)

(SEQ ID NO: 227)

ATGGACAGCCTGAAGGATTTCACCAACCTGTACCCCGTGTCCAAGACACTGCGGTTTGAGCT

GAAGCCTGTGGGCAAGACCCTGGAGAATATCGAGAAGGCCGGCATCCTGAAGGAGGATGAG

CACAGAGCCGAGAGCTACCGGAGAGTGAAGAAGATCATCGATACATATCACAAGGTGTTCA

TCGACAGCTCCCTGGAGAACATGGCCAAGATGGGCATCGAGAATGAGATCAAGGCCATGCT

GCAGTCCTTTTGCGAGCTGTATAAGAAGGACCACAGGACCGAGGGAGAGGACAAGGCCCTG

GATAAGATCAGGGCCGTGCTGAGGGGCCTGATCGTGGGAGCCTTCACCGGCGTGTGCGGCC

GGCGGGAGAACACAGTGCAGAATGAGAAGTATGAGAGCCTGTTTAAGGAGAAGCTGATCAA

GGAGATCCTGCCAGATTTCGTGCTGTCTACAGAGGCCGAGTCCCTGCCCTTTTCTGTGGAGG

AGGCCACCAGAAGCCTGAAGGAGTTCGACTCCTTTACATCTTACTTCGCCGGCTTTTATGAG

AACCGGAAGAATATCTACTCTACCAAGCCCCAGAGCACAGCCATCGCCTATAGACTGATCCA

CGAGAACCTGCCTAAGTTCATCGATAATATCCTGGTGTTTCAGAAGATCAAGGAGCCAATCG

CCAAGGAGCTGGAGCACATCAGGGCAGACTTCAGCGCCGGCGGCTACATCAAGAAGGATGA

GCGCCTGGAGGACATCTTTTCCCTGAACTACTATATCCACGTGCTGTCTCAGGCCGGCATCG

AGAAGTACAATGCCCTGATCGGCAAGATCGTGACCGAGGGCGATGGCGAGATGAAGGGCCT

GAACGAGCACATCAACCTGTATAATCAGCAGAGGGGCCGCGAGGACCGGCTGCCACTGTTC

AGACCCCTGTATAAGCAGATCCTGTCTGATAGGGAGCAGCTGTCCTATCTGCCAGAGTCTTT

CGAGAAGGACGAGGAGCTGCTGAGGGCCCTGAAGGAGTTTTACGATCACATCGCAGAGGAC

ATCCTGGGAAGGACCCAGCAGCTGATGACAAGCATCTCCGAGTACGATCTGTCCCGGATCTA

TGTGAGAAACGATAGCCAGCTGACCGACATCTCCAAGAAGATGCTGGGCGATTGGAATGCC

ATCTACATGGCCCGGGAGAGAGCCTATGACCACGAGCAGGCCCCCAAGCGCATCACAGCCA

AGTACGAGAGGGACCGCATCAAGGCCCTGAAGGGCGAGGAGTCTATCAGCCTGGCCAACCT

GAACAGCTGCATCGCCTTCCTGGACAACGTGAGGGATTGTCGCGTGGACACCTATCTGTCTA

CACTGGGACAGAAGGAGGGACCTCACGGCCTGAGCAACCTGGTGGAGAACGTGTTCGCCTC

CTACCACGAGGCCGAGCAGCTGCTGTCTTTTCCCTATCCTGAGGAGAACAATCTGATCCAGG

ACAAGGATAACGTGGTGCTGATCAAGAACCTGCTGGATAATATCAGCGACCTGCAGAGGTT

CCTGAAGCCACTGTGGGGCATGGGCGATGAGCCCGACAAGGATGAGAGGTTTTACGGCGAG

TACAATTATATCAGGGGCGCCCTGGACCAGGTCATCCCTCTGTATAACAAGGTGCGGAATTA

TCTGACCCGCAAGCCATACTCCACACGCAAGGTGAAGCTGAACTTCGGCAATAGCCAGCTGC

TGTCCGGCTGGGATAGGAACAAGGAGAAGGACAATTCTTGCGTGATCCTGCGCAAGGGCCA

-continued

```
GAACTTCTACCTGGCCATCATGAACAATCGGCACAAGCGGAGCTTCGAGAATAAGATGCTG

CCCGAGTATAAGGAGGGCGAGCCTTACTTCGAGAAGATGGATTATAAGTTTCTGCCAGACCC

CAACAAGATGCTGCCCAAGGTGTTCCTGTCTAAGAAGGGCATCGAGATCTACAAGCCTAGCC

CAAAGCTGCTGGAGCAGTATGGCCACGGCACCCACAAGAAGGGCGATACCTTCAGCATGGA

CGATCTGCACGAGCTGATCGACTTCTTTAAGCACTCCATCGAGGCCCACGAGGATTGGAAGC

AGTTCGGCTTTAAGTTCAGCGACACCGCCACATACGAGAACGTGAGCAGCTTCTACCGGGAG

GTGGAGGACCAGGGCTACAAGCTGTCTTTTAGAAAGGTGTCCGAGTCTTACGTGTATAGCCT

GATCGATCAGGGCAAGCTGTACCTGTTCCAGATCTATAACAAGGACTTTAGCCCTTGTTCCA

AGGGCACCCCAAATCTGCACACACTGTACTGGCGGATGCTGTTCGATGAGAGAAACCTGGC

CGACGTGATCTATAAGCTGGATGGCAAGGCCGAGATCTTCTTTCGGGAGAAGTCCCTGAAGA

ATGACCACCCAACCCACCCTGCAGGCAAGCCCATCAAGAAGAAGAGCCGGCAGAAGAAGG

GCGAGGAGAGCCTGTTCGAGTACGATCTGGTGAAGGACCGGAGATATACCATGGATAAGTT

TCAGTTCCACGTGCCAATCACAATGAACTTTAAGTGCTCTGCCGGCAGCAAGGTGAACGACA

TGGTGAATGCCCACATCAGGGAGGCCAAGGACATGCACGTGATCGGCATCGATAGGGGCGA

GCGCAATCTGCTGTATATCTGCGTGATCGACAGCCGCGGCACCATCCTGGATCAGATCTCCC

TGAACACAATCAATGACATCGATTATCACGATCTGCTGGAGTCCAGGGACAAGGATCGCCA

GCAGGAGCACAGGAACTGGCAGACCATCGAGGGCATCAAGGAGCTGAAGCAGGGCTACCT

GTCTCAGGCCGTGCACCGCATCGCCGAGCTGATGGTGGCCTATAAGGCCGTGGTGGCCCTGG

AGGACCTGAACATGGGCTTCAAGCGGGGCAGACAGAAGGTGGAGAGCAGCGTGTACCAGC

AGTTTGAGAAGCAGCTGATCGACAAGCTGAATTATCTGGTGGATAAGAAGAAGCGGCCCGA

GGACATCGGAGGCCTGCTGAGAGCCTACCAGTTCACCGCCCCTTTCAAGAGCTTTAAGGAGA

TGGGCAAGCAGAACGGCTTTCTGTTCTATATCCCTGCCTGGAACACATCCAATATCGACCCA

ACCACAGGCTTCGTGAACCTGTTTCACGTGCAGTACGAGAATGTGGATAAGGCCAAGAGCTT

CTTTTCAGAAGTTCGACAGCATCTCCTACAACCCTAAGAAGGATTGGTTTGAGTTCGCCTTTG

ACTATAAGAACTTCACCAAGAAGGCCGAGGGCTCTAGGAGCATGTGGATTCTGTGCACCCA

CGGCTCCCGGATCAAGAACTTCAGAAATTCTCAGAAGAATGGCCAGTGGGATAGCGAGGAG

TTTGCCCTGACCGAGGCCTTCAAGTCCCTGTTTGTGCGGTACGAGATCGATTATACCGCCGA

CCTGAAAACCGCCATCGTGGACGAGAAGCAGAAGGATTTCTTTGTGGACCTGCTGAAGCTGT

TCAAGCTGACCGTGCAGATGAGAAACTCCTGGAAGGAGAAGGACCTGGATTACCTGATCTC

TCCAGTGGCCGGCGCCGATGGCAGGTTCTTTGACACACGCGAGGGCAATAAGAGCCTGCCC

AAGGACGCAGATGCAAACGGAGCCTATAATATCGCCCTGAAGGGCCTGTGGGCACTGAGGC

AGATCAGACAGACCTCCGAGGGCGGCAAGCTGAAGCTGGCCATCTCTAACAAGGAGTGGCT

GCAGTTTGTGCAGGAGAGATCCTACGAGAAGGACAAAAGGCCGGCGGCCACGAAAAAGGCC

GGCCAGGCAAAAAAGAAAAAGGGATCCTACCCATACGATGTTCCAGATTACGCTTATCCCT

ACGACGTGCCTGATTATGCATACCCATATGATGTCCCCGACTATGCCTAAGAATTC
```

16- Prevotella disiens (PdCpf1)

(SEQ ID NO: 228)
```
ATGGAGAACTATCAGGAGTTCACCAACCTGTTTCAGCTGAATAAGACACTGAGATTCGAGCT

GAAGCCCATCGGCAAGACCTGCGAGCTGCTGGAGGAGGGCAAGATCTTCGCCAGCGGCTCC

TTTCTGGAGAAGGACAAGGTGAGGGCCGATAACGTGAGCTACGTGAAGAAGGAGATCGACA

AGAAGCACAAGATCTTTATCGAGGAGACACTGAGCTCCTTCTCTATCAGCAACGATCTGCTG

AAGCAGTACTTTGACTGCTATAATGAGCTGAAGGCCTTCAAGAAGGACTGTAAGAGCGATG
```

-continued

```
AGGAGGAGGTGAAGAAAACCGCCCTGCGCAACAAGTGTACCTCCATCCAGAGGGCCATGCG

CGAGGCCATCTCTCAGGCCTTTCTGAAGAGCCCCAGAAGAAGCTGCTGGCCATCAAGAACC

TGATCGAGAACGTGTTCAAGGCCGACGAGAATGTGCAGCACTTCTCCGAGTTTACCAGCTAT

TTCTCCGGCTTTGAGACAAACAGAGAGAATTTCTACTCTGACGAGGAGAAGTCCACATCTAT

CGCCTATAGGCTGGTGCACGATAACCTGCCTATCTTCATCAAGAACATCTACATCTTCGAGA

AGCTGAAGGAGCAGTTCGACGCCAAGACCCTGAGCGAGATCTTCGAGAACTACAAGCTGTA

TGTGGCCGGCTCTAGCCTGGATGAGGTGTTCTCCCTGGAGTACTTTAACAATACCCTGACAC

AGAAGGGCATCGACAACTATAATGCCGTGATCGGCAAGATCGTGAAGGAGGATAAGCAGGA

GATCCAGGGCCTGAACGAGCACATCAACCTGTATAATCAGAAGCACAAGGACCGGAGACTG

CCCTTCTTTATCTCCCTGAAGAAGCAGATCCTGTCCGATCGGGAGGCCCTGTCTTGGCTGCCT

GACATGTTCAAGAATGATTCTGAAGTGATCAAGGCCCTGAAGGGCTTCTACATCGAGGACG

GCTTTGAGAACAATGTGCTGACACCTCTGGCCACCCTGCTGTCCTCTCTGGATAAGTACAAC

CTGAATGGCATCTTTATCCGCAACAATGAGGCCCTGAGCTCCCTGTCCCAGAACGTGTATCG

GAATTTTTCTATCGACGAGGCCATCGATGCCAACGCCGAGCTGCAGACCTTCAACAATTACG

AGCTGATCGCCAATGCCCTGCGCGCCAAGATCAAGAAGGAGACAAAGCAGGGCCGGAAGTC

TTTCGAGAAGTACGAGGAGTATATCGATAAGAAGGTGAAGGCCATCGACAGCCTGTCCATC

CAGGAGATCAACGAGCTGGTGGAGAATTACGTGAGCGAGTTTAACTCTAATAGCGGCAACA

TGCCAAGAAAGGTGGAGGACTACTTCAGCCTGATGAGGAAGGGCGACTTCGGCTCCAACGA

TCTGATCGAAAATATCAAGACCAAGCTGAGCGCCGCAGAGAAGCTGCTGGGCACAAAGTAC

CAGGAGACAGCCAAGGACATCTTCAAGAAGGATGAGAACTCCAAGCTGATCAAGGAGCTGC

TGGACGCCACCAAGCAGTTCCAGCACTTTATCAAGCCACTGCTGGGCACAGGCGAGGAGGC

AGATCGGGACCTGGTGTTCTACGGCGATTTTCTGCCCCTGTATGAGAAGTTTGAGGAGCTGA

CCCTGCTGTATAACAAGGTGCGGAATAGACTGACACAGAAGCCCTATTCCAAGGACAAGAT

CCGCCTGTGCTTCAACAAGCCTAAGCTGATGACAGGCTGGGTGGATTCCAAGACCGAGAAG

TCTGACAACGGCACACAGTACGGCGGCTATCTGTTTCGGAAGAAGAATGAGATCGGCGAGT

ACGATTATTTCTGGGCATCTCTAGCAAGGCCCAGCTGTTCAGAAAGAACGAGGCCGTGATC

GGCGACTACGAGAGGCTGGATTACTATCAGCCAAAGGCCAATACCATCTACGGCTCTGCCTA

TGAGGGCGAGAACAGCTACAAGGAGGACAAGAAGCGGCTGAACAAAGTGATCATCGCCTAT

ATCGAGCAGATCAAGCAGACAAACATCAAGAAGTCTATCATCGAGTCCATCTCTAAGTATCC

TAATATCAGCGACGATGACAAGGTGACCCCATCCTCTCTGCTGGAGAAGATCAAGAAGGTG

TCTATCGACAGCTACAACGGCATCCTGTCCTTCAAGTCTTTTCAGAGCGTGAACAAGGAAGT

GATCGATAACCTGCTGAAAACCATCAGCCCCCTGAAGAACAAGGCCGAGTTTCTGGACCTG

ATCAATAAGGATTATCAGATCTTCACCGAGGTGCAGGCCGTGATCGACGAGATCTGCAAGC

AGAAAACCTTCATCTACTTTCCAATCTCCAACGTGGAGCTGGAGAAGGAGATGGGCGATAA

GGACAAGCCCCTGTGCCTGTTCCAGATCAGCAATAAGGATCTGTCCTTCGCCAAGACCTTTA

GCGCCAACCTGCGGAAGAAGAGAGGCGCCGAGAATCTGCACACAATGCTGTTTAAGGCCCT

GATGGAGGGCAACCAGGATAATCTGGACCTGGGCTCTGGCGCCATCTTCTACAGAGCCAAG

AGCCTGGACGGCAACAAGCCCACACACCCTGCCAATGAGGCCATCAAGTGTAGGAACGTGG

CCAATAAGGATAAGGTGTCCCTGTTCACCTACGACATCTATAAGAACAGGCGCTACATGGAG

AATAAGTTCCTGTTTCACCTGAGCATCGTGCAGAACTATAAGGCCGCCAATGACTCCGCCCA
```

-continued

GCTGAACAGCTCCGCCACCGAGTATATCAGAAAGGCCGATGACCTGCACATCATCGGCATC
GATAGGGGCGAGCGCAATCTGCTGTACTATTCCGTGATCGATATGAAGGGCAACATCGTGG
AGCAGGACTCTCTGAATATCATCAGGAACAATGACCTGGAGACAGATTACCACGACCTGCT
GGATAAGAGGGAGAAGGAGCGCAAGGCCAACCGGCAGAATTGGGAGGCCGTGGAGGGCAT
CAAGGACCTGAAGAAGGGCTACCTGAGCCAGGCCGTGCACCAGATCGCCCAGCTGATGCTG
AAGTATAACGCCATCATCGCCCTGGAGGATCTGGGCCAGATGTTTGTGACCCGCGGCCAGAA
GATCGAGAAGGCCGTGTACCAGCAGTTCGAGAAGAGCCTGGTGGATAAGCTGTCCTACCTG
GTGGACAAGAAGCGGCCTTATAATGAGCTGGGCGGCATCCTGAAGGCCTACCAGCTGGCCT
CTAGCATCACCAAGAACAATTCTGACAAGCAGAACGGCTTCCTGTTTTATGTGCCAGCCTGG
AATACAAGCAAGATCGATCCCGTGACCGGCTTTACAGACCTGCTGCGGCCCAAGGCCATGA
CCATCAAGGAGGCCCAGGACTTCTTTGGCGCCTTCGATAACATCTCTTACAATGACAAGGGC
TATTTCGAGTTTGAGACAAACTACGACAAGTTTAAGATCAGAATGAAGAGCGCCCAGACCA
GGTGGACAATCTGCACCTTCGGCAATCGGATCAAGAGAAAGAAGGATAAGAACTACTGGAA
TTATGAGGAGGTGGAGCTGACCGAGGAGTTCAAGAAGCTGTTTAAGGACAGCAACATCGAT
TACGAGAACTGTAATCTGAAGGAGGAGATCCAGAACAAGGACAATCGCAAGTTCTTTGATG
ACCTGATCAAGCTGCTGCAGCTGACACTGCAGATGCGGAACTCCGATGACAAGGGCAATGA
TTATATCATCTCTCCTGTGGCCAACGCCGAGGGCCAGTTCTTTGACTCCCGCAATGGCGATA
AGAAGCTGCCACTGGATGCAGACGCAAACGGAGCCTACAATATCGCCCGCAAGGGCCTGTG
GAACATCCGGCAGATCAAGCAGACCAAGAACGACAAGAAGCTGAATCTGAGCATCTCCTCT
ACAGAGTGGCTGGATTTCGTGCGGGAGAAGCCTTACCTGAAGAAAAGGCCGGCGGCCACGAA
*AAAGGCCGGCCAGGCAAAAAAGAAAAAGG<u>GGATCC</u>*TACCCATACGATGTTCCAGATTACGCTT*
*ATCCCTACGACGTGCCTGATTATGCATACCCATATGATGTCCCCGACTATGCCTAAGAA*
*TTC*
17- Porphyromonas macacae (PmCpf1)

(SEQ ID NO: 229)

ATGAAAACCCAGCACTTCTTTGAGGACTTCACAAGCCTGTACTCTCTGAGCAAGACCATCCG
GTTTGAGCTGAAGCCAATCGGCAAGACCCTGGAGAACATCAAGAAGAATGGCCTGATCCGG
AGAGATGAGCAGAGACTGGACGATTACGAGAAGCTGAAGAAAGTGATCGACGAGTATCAC
GAGGATTTCATCGCCAACATCCTGAGCTCCTTTTCCTTCTCTGAGGAGATCCTGCAGTCCTAC
ATCCAGAATCTGAGCGAGTCCGAGGCCAGGGCCAAGATCGAGAAAACCATGCGCGACACAC
TGGCCAAGGCCTTCTCTGAGGATGAGAGGTACAAGAGCATCTTTAAGAAGGAGCTGGTGAA
GAAGGACATCCCCGTGTGGTGCCCTGCCTATAAGAGCCTGTGCAAGAAGTTCGATAACTTTA
CCACATCTCTGGTGCCCTTCCACGAGAACAGGAAGAACCTGTATACCAGCAATGAGATCACA
GCCTCTATCCCTTATCGCATCGTGCACGTGAACCTGCCAAAGTTTATCCAGAATATCGAGGC
CCTGTGCGAGCTGCAGAAGAAGATGGGCGCCGACCTGTACCTGGAGATGATGGAGAACCTG
CGCAACGTGTGGCCCAGCTTCGTGAAAACCCCAGACGACCTGTGCAACCTGAAAACCTATA
ATCACCTGATGGTGCAGTCTAGCATCAGCGAGTACAACAGGTTTGTGGGCGGCTATTCCACC
GAGGACGGCACAAAGCACCAGGGCATCAACGAGTGGATCAATATCTACAGACAGAGGAAT
AAGGAGATGCGCCTGCCTGGCCTGGTGTTCCTGCACAAGCAGATCCTGGCCAAGGTGGACTC
CTCTAGCTTCATCAGCGATACACTGGAGAACGACGATCAGGTGTTTTGCGTGCTGAGACAGT
TCAGGAAGCTGTTTTGGAATACCGTGTCCTCTAAGGAGGACGATGCCGCCTCCCTGAAGGAC
CTGTTCTGTGGCCTGTCTGGCTATGACCCTGAGGCCATCTACGTGAGCGATGCCCACCTGGC

-continued

```
CACAATCTCCAAGAACATCTTTGACAGATGGAATTACATCTCCGATGCCATCAGGCGCAAGA

CCGAGGTGCTGATGCCACGGAAGAAGGAGAGCGTGGAGAGATATGCCGAGAAGATCTCCAA

GCAGATCAAGAAGAGACAGTCTTACAGCCTGGCCGAGCTGGACGATCTGCTGGCCCACTAT

AGCGAGGAGTCCCTGCCCGCAGGCTTCTCTCTGCTGAGCTACTTTACATCTCTGGGCGGCCA

GAAGTATCTGGTGAGCGACGGCGAAGTGATCCTGTACGAGGAGGGCAGCAACATCTGGGAC

GAGGTGCTGATCGCCTTCAGGGATCTGCAGGTCATCCTGGACAAGGACTTCACCGAGAAGA

AGCTGGGCAAGGATGAGGAGGCCGTGTCTGTGATCAAGAAGGCCCTGGACAGCGCCCTGCG

CCTGCGGAAGTTCTTTGATCTGCTGTCCGGCACAGGCGCAGAGATCAGGAGAGACAGCTCCT

TCTATGCCCTGTATACCGACCGGATGGATAAGCTGAAGGGCCTGCTGAAGATGTATGATAAG

GTGAGAAACTACCTGACCAAGAAGCCTTATTCCATCGAGAAGTTCAAGCTGCACTTTGACAA

CCCATCCCTGCTGTCTGGCTGGGATAAGAATAAGGAGCTGAACAATCTGTCTGTGATCTTCC

GGCAGAACGGCTACTATTACCTGGGCATCATGACACCCAAGGGCAAGAATCTGTTCAAGAC

CCTGCCTAAGCTGGGCGCCGAGGAGATGTTTTATGAGAAGATGGAGTACAAGCAGATCGCC

GAGCCTATGCTGATGCTGCCAAAGGTGTTCTTTCCCAAGAAAACCAAGCCAGCCTTCGCCCC

AGACCAGAGCGTGGTGGATATCTACAACAAGAAAACCTTCAAGACAGGCCAGAAGGGCTTT

AATAAGAAGGACCTGTACCGGCTGATCGACTTCTACAAGGAGGCCCTGACAGTGCACGAGT

GGAAGCTGTTTAACTTCTCCTTTTCTCCAACCGAGCAGTATCGGAATATCGGCGAGTTCTTTG

ACGAGGTGAGAGAGCAGGCCTACAAGGTGTCCATGGTGAACGTGCCCGCCTCTTATATCGA

CGAGGCCGTGGAGAACGGCAAGCTGTATCTGTTCCAGATCTACAATAAGGACTTCAGCCCCT

ACTCCAAGGGCATCCCTAACCTGCACACACTGTATTGGAAGGCCCTGTTCAGCGAGCAGAAT

CAGAGCCGGGTGTATAAGCTGTGCGGAGGAGGAGAGCTGTTTTATAGAAAGGCCAGCCTGC

ACATGCAGGACACCACAGTGCACCCCAAGGGCATCTCTATCCACAAGAAGAACCTGAATAA

GAAGGGCGAGACAAGCCTGTTCAACTACGACCTGGTGAAGGATAAGAGGTTTACCGAGGAC

AAGTTCTTTTTCCACGTGCCTATCTCTATCAACTACAAGAATAAGAAGATCACCAACGTGAA

TCAGATGGTGCGCGATTATATCGCCCAGAACGACGATCTGCAGATCATCGGCATCGACCGCG

GCGAGCGGAATCTGCTGTATATCAGCCGGATCGATACAAGGGGCAACCTGCTGGAGCAGTT

CAGCCTGAATGTGATCGAGTCCGACAAGGGCGATCTGAGAACCGACTATCAGAAGATCCTG

GGCGATCGCGAGCAGGAGCGGCTGAGGCGCCGGCAGGAGTGGAAGTCTATCGAGAGCATCA

AGGACCTGAAGGATGGCTACATGAGCCAGGTGGTGCACAAGATCTGTAACATGGTGGTGGA

GCACAAGGCCATCGTGGTGCTGGAGAACCTGAATCTGAGCTTCATGAAGGGCAGGAAGAAG

GTGGAGAAGTCCGTGTACGAGAAGTTTGAGCGCATGCTGGTGGACAAGCTGAACTATCTGG

TGGTGGATAAGAAGAACCTGTCCAATGAGCCAGGAGGCCTGTATGCAGCATACCAGCTGAC

CAATCCACTGTTCTCTTTTGAGGAGCTGCACAGATACCCCCAGAGCGGCATCCTGTTTTTCGT

GGACCCATGGAACACCTCTCTGACAGATCCCAGCACAGGCTTCGTGAATCTGCTGGGCAGAA

TCAACTACACCAATGTGGGCGACGCCCGCAAGTTTTTCGATCGGTTTAACGCCATCAGATAT

GACGGCAAGGGCAATATCCTGTTCGACCTGGATCTGTCCAGATTTGATGTGAGGGTGGAGAC

ACAGAGGAAGCTGTGGACACTGACCACATTCGGCTCTCGCATCGCCAAATCCAAGAAGTCT

GGCAAGTGGATGGTGGAGCGGATCGAGAACCTGAGCCTGTGCTTTCTGGAGCTGTTCGAGC

AGTTTAATATCGGCTACAGAGTGGAGAAGGACCTGAAGAAGGCCATCCTGAGCCAGGATAG

GAAGGAGTTCTATGTGCGCCTGATCTACCTGTTTAACCTGATGATGCAGATCCGGAACAGCG

ACGGCGAGGAGGATTATATCCTGTCTCCCGCCCTGAACGAGAAGAATCTGCAGTTCGACAGC
```

-continued

```
AGGCTGATCGAGGCCAAGGATCTGCCTGTGGACGCAGATGCAAACGGAGCATACAATGTGG

CCCGCAAGGGCCTGATGGTGGTGCAGAGAATCAAGAGGGGCGACCACGAGTCCATCCACAG

GATCGGAAGGGCACAGTGGCTGAGATATGTGCAGGAGGGCATCGTGGAGAAAAGGCCGGCG

GCCACGAAAAAGGCCGGCCAGGCAAAAAAGAAAAAGGGATCCTACCCATACGATGTTCCAGA

TTACGCTTATCCCTACGACGTGCCTGATTATGCATACCCATATGATGTCCCCGACTATG

CCTAAGAATTC
```

Amino acid sequence of human codon optimized Cpf1 orthologs
*Nuclear localization signal (NLS)*
<u>Glycine-Serine linker</u>
3x HA tag
1- Franscisella tularensis subsp. novicida U112 (FnCpf1)

(SEQ ID NO: 230)

MSIYQEFVNKYSLSKTLRFELIPQGKTLENIKARGLILDDEKRAKDYKKAKQIIDKYHQFFIEEILS

SVCISEDLLQNYSDVYFKLKKSDDDNLQKDFKSAKDTIKKQISEYIKDSEKFKNLFNQNLIDAKK

GQESDLILWLKQSKDNGIELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKTSEVNQRVFSLDEVFEI

ANFNNYLNQSGITKFNTIIGGKFVNGENTKRKGINEYINLYSQQINDKTLKKYKMSVLFKQILSDT

ESKSFVIDKLEDDSDVVTTMQSFYEQIAAFKTVEEKSIKETLSLLFDDLKAQKLDLSKIYFKNDKS

LTDLSQQVFDDYSVIGTAVLEYITQQIAPKNLDNPSKKEQELIAKKTEKAKYLSLETIKLALEEFN

KHRDIDKQCRFEEILANFAAIPMIFDEIAQNKDNLAQISIKYQNQGKKDLLQASAEDDVKAIKDLL

DQTNNLLHKLKIFHISQSEDKANILDKDEHFYLVFEECYFELANIVPLYNKIRNYITQKPYSDEKF

KLNFENSTLANGWDKNKEPDNTAILFIKDDKYYLGVMNKKNNKIFDDKAIKENKGEGYKKIVY

KLLPGANKMLPKVFFSAKSIKFYNPSEDILRIRNHSTHTKNGSPQKGYEKFEFNIEDCRKFIDFYK

QSISKHPEWKDFGFRFSDTQRYNSIDEFYREVENQGYKLTFENISESYIDSVVNQGKLYLFQIYNK

DFSAYSKGRPNLHTLYWKALFDERNLQDVVYKLNGEAELFYRKQSIPKKITHPAKEMANKNKD

NPKKESVFEYDLIKDKRFTEDKFFFHCPITINFKSSGANKFNDEINLLLKEKANDVHILSIDRGERH

LAYYTLVDGKGNIIKQDTFNIIGNDRMKTNYHDKLAAIEKDRDSARKDWKKINNIKEMKEGYLS

QVVHEIAKLVIEYNAIVVFEDLNFGFKRGRFKVEKQVYQKLEKMLIEKLNYLVFKDNEFDKTGG

VLRAYQLTAPFETFKKMGKQTGITYYVPAGFTSKICPVTGFVNQLYPKYESVSKSQEFFSKFDKIC

YNLDKGYFEFSFDYKNFGDKAAKGKWTIASFGSRLINFRNSDKNFINWDTREVYPTKELEKLLK

DYSIEYGHGECIKAAICGESDKKFFAKLTSVLNTILQMRNSKTGTELDYLISPVADVNGNFFDSRQ

APKNMPQDADANGAYHIGLKGLMLLGRIKNNQEGKKLNLVIKNEEYFEFVQNRNN*KRPAATKK*

*AGQAKKKKGS*YPYDVPDYAYPYDVPDYAYPYDVPDYA

3- Lachnospiraceae bacterium MC2017 (Lb3Cpf1)

(SEQ ID NO: 231)

MDYGNGQFERRAPLTKTITLRLKPIGETRETIREQKLLEQDAAFRKLVETVTPIVDD CIRK

IADNAL CHF GTEYDF SCLGNAISKND SKAIKKETEKVEKLLAKVLTENLPDGLRKVNDIN

SAAFIQDTLTSFVQDDADKRVLIQELKGKTVLMQRFLTTRITALTVWLPDRVFENFNIFIE

NAEKMRILLDSPLNEKIMKFDPDAEQYASLEFYGQCLSQKDISYNLIISGIYADDEVKN

PGINEIVKEYNQQIRGDKDESPLPKLKKLHKQILMPVEKAFFVRVLSNDSDARSILEKILK

DTEMLPSKIIEAMKEADAGDIAVYGSRLHELSHVIYGDHGKLSQIIYDKESKRISELMETL

SPKERKESKKRLEGLEEHIRKSTYTFDELNRYAEKNVMAAYIAAVEESCAEIMRKEKDL

RTLLSKEDVKIRGNRHNTLIVKNYFNAWTVFRNLIRILRRKSEAEIDSDFYDVLDDSVEV

LSLTYKGENLCRSYITKKIGSDLKPEIATYGSALRPNSRWWSPGEKFNVKFHTIVRRDGR

LYYFILPKGAKPVELEDMDGDIECLQMRKIPNPTIFLPKLVFKDPEAFFRDNPEADEFVFL

-continued

```
SGMKAPVTITRETYEAYRYKLYTVGKLRDGEVSEEEYKRALLQVLTAYKEFLENRMIY

ADLNFGFKDLEEYKDSSEFIKQVETHNTFMCWAKVSSSQLDDLVKSGNGLLFEIWSERL

ESYYKYGNEKVLRGYEGVLLSILKDENLVSMRTLLNSRPMLVYRPKESSKPMVVHRDG

SRVVDRFDKDGKYIPPEVHDELYRFFNNLLIKEKLGEKARKILDNKKVKVKVLESERVK

WSKFYDEQFAVTFSVKKNADCLDTTKDLNAEVMEQYSESNRLILIRNTTDILYYLVLDK

NGKVLKQRSLNIINDGARDVDWKERFRQVTKDRNEGYNEWDYSRTSNDLKEVYLNYA

LKEIAEAVIEYNAILIIEKMSNAFKDKYSFLDDVTFKGFETKLLAKLSDLHFRGIKDGEPC

SFTNPLQLCQNDSNKILQDGVIFMVPNSMTRSLDPDTGFIFAINDHNIRTKKAKLNFLSKF

DQLKVSSEGCLIMKYSGDSLPTHNTDNRVWNCCCNHPITNYDRETKKVEFIEEPVEELS

RVLEENGIETDTELNKLNERENVPGKVVDAIYSLVLNYLRGTVSGVAGQRAVYYSPVTG

KKYDISFIQAMNLNRKCDYYRIGSKERGEWTDFVAQLIN*KRPAATKKAGQAKKKK*GS̲YP
```

YDVPDYAYPYDVPDYAYPYDVPDYA
4- Butyrivibrio proteoclasticus (BpCpf1)
(SEQ ID NO: 232)

```
MLLYENYTKRNQITKSLRLELRPQGKTLRNIKELNLLEQDKAIYALLERLKPVIDEGIKDIARDTL

KNCELSFEKLYEHFLSGDKKAYAKESERLKKEIVKTLIKNLPEGIKISEINSAKYLNGVLYDFID

KTHKDSEEKQNILSDILETKGYLALFSKFLTSRITTLEQSMPKRVIENFEIYAANIPKMQDALERGA

VSFAIEYESICSVDYYNQILSQEDIDSYNRLISGIMDEDGAKEKGINQTISEKNIKIKSEHLEEKPFRI

LKQLHKQILEEREKAFTIDHIDSDEEVVQVTKEAFEQTKEQWENIKKINGFYAKDPGDITLFIVVG

PNQTHVLSQLIYGEHDRIRLLLEEYEKNTLEVLPRRTKSEKARYDKFVNAVPKKVAKESHTFDGL

QKMTGDDRLFILYRDELARNYMRIKEAYGTFERDILKSRRGIKGNRDVQESLVSFYDELTKFRSA

LRIINSGNDEKADPIFYNTFDGIFEKANRTYKAENLCRNYVTKSPADDARIMASCLGTPARLRTH

WWNGEENFAINDVAMIRRGDEYYYFVLTPDVKPVDLKTKDETDAQIFVQRKGAKSFLGLPKAL

FKCILEPYFESPEHKNDKNCVIEEYVSKPLTIDRRAYDIFKNGTFKKTNIGIDGLTEEKFKDDCRYL

IDVYKEFIAVYTRYSCFNMSGLKRADEYNDIGEFFSDVDTRLCTMEWIPVSFERINDMVDKKEGL

LFLVRSMFLYNRPRKPYERTFIQLFSDSNMEHTSMLLNSRAMIQYRAASLPRRVTHKKGSILVAL

RDSNGEHIPMHIREAIYKMKNNFDISSEDFIMAKAYLAEHDVAIKKANEDIIRNRRYTEDKFFLSL

SYTKNADISARTLDYINDKVEEDTQDSRMAVIVTRNLKDLTYVAVVDEKNNVLEEKSLNEIDGV

NYRELLKERTKIKYHDKTRLWQYDVSSKGLKEAYVELAVTQISKLATKYNAVVVESMSSTFK

DKFSFLDEQIFKAFEARLCARMSDLSFNTIKEGEAGSISNPIQVSNNNGNSYQDGVIYFLNNAYTR

TLCPDTGFVDVFDKTRLITMQSKRQFFAKMKDIRIDDGEMLFTFNLEEYPTKRLLDRKEWTVKIA

GDGSYFDKDKGEYVYVNDIVREQIIPALLEDKAVFDGNMAEKFLDKTAISGKSVELIYKWFANA

LYGIITKKDGEKIYRSPITGTEIDVSKNTTYNFGKKFMFKQEYRGDGDFLDAFLNYMQAQDIAV*K*

*RPAATKKAGQAKKKK*GS̲YPYDVPDYAYPYDVPDYAYPYDVPDYA
```

5- Peregrinibacteria bacterium GW2011_GWA_33_10 (PeCpf1)
(SEQ ID NO: 233)

```
MSNFFKNFTNLYELSKTLRFELKPVGDTLTNMKDHLEYDEKLQTFLKDQNIDDAYQALKPQFDE

IHEEFITDSLESKKAKEIDFSEYLDLFQEKKELNDSEKKLRNKIGETFNKAGEKWKKEKYPQYEW

KKGSKIANGADILSCQDMLQFIKYKNPEDEKIKNYIDDTLKGFFTYFGGFNQNRANYYETKKEAS

TAVATRIVHENLPKFCDNVIQFKHIIKRKKDGTVEKTERKTEYLNAYQYLKNNNKITQIKDAETE

KMIESTPIAEKIFDVYYFSSCLSQKQIEEYNRIIGHYNLLINLYNQAKRSEGKHLSANEKKYKDLP

KFKTLYKQIGCGKKKDLFYTIKCDTEEEANKSRNEGKESHSVEEIINKAQEAINKYFKSNNDCENI

NTVPDFINYILTKENYEGVYWSKAAMNTISDKYFANYHDLQDRLKEAKVFQKADKKSEDDIKIP
```

-continued

EAIELSGLFGVLDSLADWQTTLFKSSILSNEDKLKIITDSQTPSEALLKMIFNDIEKNMESFLKETN

DIITLKKYKGNKEGTEKIKQWFDYTLAINRMLKYFLVKENKIKGNSLDTNISEALKTLIYSDDAE

WFKWYDALRNYLTQKPQDEAKENKLKLNFDNPSLAGGWDVNKECSNFCVILKDKNEKKYLAI

MKKGENTLFQKEWTEGRGKNLTKKSNPLFEINNCEILSKMEYDFWADVSKMIPKCSTQLKAVV

NHFKQSDNEFIFPIGYKVTSGEKFREECKISKQDFELNNKVFNKNELSVTAMRYDLSSTQEKQYIK

AFQKEYWELLFKQEKRDTKLTNNEIFNEWINFCNKKYSELLSWERKYKDALTNWINFCKYFLSK

YPKTTLFNYSFKESENYNSLDEFYRDVDIC SYKLNINTTINKSILDRLVEEGKLYLFEIKNQDSND

GKSIGHKNNLHTIYWNAIFENFDNRPKLNGEAEIFYRKAISKDKLGIVKGKKTKNGTEIIKNYRFS

KEKFILHVPITLNFCSNNEYVNDIVNTKFYNF SNLHFLGIDRGEKHLAYYSLVNKNGEIVDQGTL

NLPFTDKDGNQRSIKKEKYFYNKQEDKWEAKEVDCWNYNDLLDAMASNRDMARKNWQRIGTI

KEAKNGYVSLVIRKIADLAVNNERPAFIVLEDLNTGFKRSRQKIDKSVYQKFELALAKKLNFLVD

KNAKRDEIGSPTKALQLTPPVNNYGDIENKKQAGIMLYTRANYTSQTDPATGWRKTIYLKAGPE

ETTYKKDGKIKNKSVKDQIIETFTDIGFDGKDYYFEYDKGEFVDEKTGEIKPKKWRLYSGENGKS

LDRFRGEREKDKYEWKIDKIDIVKILDDLFVNFDKNISLLKQLKEGVELTRNNEHGTGESLRFAIN

LIQQIRNTGNNERDNDFILSPVRDENGKHFDSREYWDKETKGEKISMPSGDANGAFNIARKGII

MNAHILANSDSKDLSLFVSDEEWDLHLNNKTEWKKQLNIFSSRKAMA*KRKKKRPAATKKAGQAK*

*KKKGS*YPYDVPDYAYPYDVPDYAYPYDVPDYA

6- Parcubacteria bacterium GWC2011_GWC2_44_17 (PbCpf1)

(SEQ ID NO: 234)

MENIFDQFIGKYSLSKTLRFELKPVGKTEDFLKINKVFEKDQTIDDSYNQAKFYFDSLHQKFIDAA

LASDKTSELSFQNFADVLEKQNKIILDKKREMGALRKRDKNAVGIDRLQKEINDAEDIIQKEKEKI

YKDVRTLFDNEAESWKTYYQEREVDGKKITFSKADLKQKGADFLTAAGILKVLKYEFPEEKEKE

FQAKNQPSLFVEEKENPGQKRYIFDSFDKFAGYLTKFQQTKKNLYAADGTSTAVATRIADNFIIF

HQNTKVFRDKYKNNHTDLGFDEENIFEIERYKNCLLQREIEHIKNENSYNKIIGRINKKIKEYRDQ

KAKDTKLTKSDFPFFKNLDKQILGEVEKEKQLIEKTREKTEEDVLIERFKEFIENNEERFTAAKKL

MNAFCNGEFESEYEGIYLKNKAINTISRRWFVSDRDFELKLPQQKSKNKSEKNEPKVKKFISIAEI

KNAVEELDGDIFKAVFYDKKIIAQGGSKLEQFLVIWKYEFEYLFRDIERENGEKLLGYDSCLKIA

KQLGIFPQEKEAREKATAVIKNYADAGLGIFQMMKYFSLDDKDRKNTPGQLSTNFYAEYDGYY

KDFEFIKYYNEFRNFITKKPFDEDKIKLNFENGALLKGWDENKEYDFMGVILKKEGRLYLGIMH

KNHRKLFQ SMGNAKGDNANRYQKMIYKQIADASKDVPRLLLTSKKAMEKFKPSQEILRIKKEKT

FKRESKNFSLRDLHALIEYYRNCIPQYSNWSFYDFQFQDTGKYQNIKEFTDDVQKYGYKISFRDI

DDEYINQALNEGKMYLFEVVNKDIYNTKNGSKNLHTLYFEHILSAENLNDPVFKLSGMAEIFQR

QPSVNEREKITTQKNQCILDKGDRAYKYRRYTEKKIMFHMSLVLNTGKGEIKQVQFNKIINQRIS

SSDNEMRVNVIGIDRGEKNLLYYSVVKQNGEIIEQASLNEINGVNYRDKLIEREKERLKNRQSWK

PVVKIKDLKKGYISHVIHKICQLIEKYSAIVVLEDLNMRFKQIRGGIERSVYQQFEKALIDKLGYL

VFKDNRDLRAPGGVLNGYQLSAPFVSFEKMRKQTGILFYTQAEYTSKTDPITGFRKNVYISNSAS

LDKIKEAVKKFDAIGWDGKEQSYFFKYNPYNLADEKYKNSTVSKEWAIFASAPRIRRQKGEDGY

WKYDRVKVNEEFEKLLKVWNFVNPKATDIKQEIIKKEKAGDLQGEKELDGRLRNFWHSFIYLFN

-continued

LVLELRNSFSLQIKIKAGEVIAVDEGVDFIASPVKPFFTTPNPYIPSNLCWLAVENADANGAYNIA

RKGVMILKKIREHAKKDPEFKKLPNLFISNAEWDEAARDWGKYAGTTALNLDH*KRPAATKKAG*

*QAKKKKGS*YPYDVPDYAYPYDVPDYAYPYDVPDYA
7- Smithella sp. SC_K08D17 (SsCpf1)

(SEQ ID NO: 235)
MQTLFENFTNQYPVSKTLRFELIPQGKTKDFIEQKGLLKKDEDRAEKYKKVKNIIDEYHKDFIEKS

LNGLKLDGLEKYKTLYLKQEKDDKDKKAFDKEKENLRKQIANAFRNNEKFKTLFAKELIKNDL

MSFACEEDKKNVKEFEAFTTYFTGFHQNRANMYVADEKRTAIASRLIHENLPKFIDNIKIFEKMK

KEAPELLSPFNQTLKDMKDVIKGTTLEEIFSLDYFNKTLTQSGIDIYNSVIGGRTPEEGKTKIKGLN

EYINTDFNQKQTDKKKRQPKFKQLYKQILSDRQSLSFIAEAFKNDTEILEAIEKFYVNELLHFSNE

GKSTNVLDAIKNAVSNLESFNLTKMYFRSGASLTDVSRKVFGEWSIINRALDNYYATTYPIKPRE

KSEKYEERKEKWLKQDFNVSLIQTAIDEYDNETVKGKNSGKVIADYFAKFCDDKETDLIQKVNE

GYIAVKDLLNTPCPENEKLGSNKDQVKQIKAFMDSIMDIMHFVRPLSLKDTDKEKDETFYSLFTP

LYDHLTQTIALYNKVRNYLTQKPYSTEKIKLNFENSTLLGGWDLNKETDNTAIILRKDNLYYLGI

MDKRHNRIFRNVPKADKKDFCYEKMVYKLLPGANKMLPKVFFSQSRIQEFTPSAKLLENYANET

HKKGDNFNLNHCHKLIDFFKDSINKHEDWKNFDFRFSATSTYADLSGFYHEVEHQGYKISFQSV

ADSFIDDLVNEGKLYLFQIYNKDFSPFSKGKPNLHTLYWKMLFDENNLKDVVYKLNGEAEVFYR

KKSIAEKNTTIHKANESIINKNPDNPKATSTFNYDIVKDKRYTIDKFQFHIPITMNFKAEGIFNMNQ

RVNQFLKANPDINIIGIDRGERHLLYYALINQKGKILKQDTLNVIANEKQKVDYHNLLDKKEGDR

ATARQEWGVIETIKELKEGYLSQVIHKLTDLMIENNAIIVMEDLNFGFKRGRQKVEKQVYQKFE

KMLIDKLNYLVDKNKKANELGGLLNAFQLANKFESFQKMGKQNGFIFYVPAWNTSKTDPATGF

IDFLKPRYENLNQAKDFFEKFDSIRLNSKADYFEFAFDFKNFTEKADGGRTKWTVCTTNEDRYA

WNRALNNNRGSQEKYDITAELKSLFDGKVDYKSGKDLKQQIASQESADFFKALMKNLSITLSLR

HNNGEKGDNEQDYILSPVADSKGRFFDSRKADDDMPKNADANGAYHIALKGLWCLEQISKTDD

LKKVKLAISNKEWLEFVQTLKG*KRPAATKKAGQAKKKKGS*YPYDVPDYAYPYDVPDYAYPYDV

PDYA
8- Acidaminococcus sp. BV3L6 (AsCpf1)

(SEQ ID NO: 236)
MTQFEGFTNLYQVSKTLRFELIPQGKTLKHIQEQGFIEEDKARNDHYKELKPIIDRIYKTYADQCL

QLVQLDWENLSAAIDSYRKEKTEETRNALIEEQATYRNAIHDYFIGRTDNLTDAINKRHAEIYKG

LFKAELFNGKVLKQLGTVTTTEHENALLRSFDKFTTYF SGFYENRKNVFSAEDISTAIPHRIVQDN

FPKFKENCHIFTRLITAVPSLREHFENVKKAIGIFVSTSIEEVFSFPPFYNQLLTQTQIDLYNQLLGGIS

REAGTEKIKGLNEVLNLAIQKNDETAHIIASLPHRFIPLFKQILSDRNTLSFILEEFKSDEEVIQSFCK

YKTLLRNENVLETAEALFNELNSIDLTHIFISHKKLETISSALCDHWDTLRNALYERRISELTGKIT

KSAKEKVQRSLKHEDINLQEIISAAGKELSEAFKQKTSEILSHAHAALDQPLPTTLKKQEEKEILKS

QLDSLLGLYHLLDWFAVDESNEVDPEF SARLTGIKLEMEPSLSFYNKARNYATKKPYSVEKFKL

NFQMPTLASGWDVNKEKNNGAILFVKNGLYYLGIMPKQKGRYKALSFEPTEKTSEGFDKMYYD

YFPDAAKMIPKCSTQLKAVTAHFQTHTTPILLSNNFIEPLEITKEIYDLNNPEKEPKKFQTAYAKK

TGDQKGYREALCKWIDFTRDFLSKYTKTTSIDLSSLRPS SQYKDLGEYYAELNPLLYHISFQRIAE

KEIMDAVETGKLYLFQIYNKDFAKGHHGKPNLHTLYWTGLFSPENLAKTSIKLNGQAELFYRPK

SRMKRMAHRLGEKMLNKKLKDQKTPIPDTLYQELYDYVNHRLSHDLSDEARALLPNVITKEVS

HEIIKDRRFTSDKFFFHVPITLNYQAANSPSKFNQRVNAYLKEHPETPIIGIDRGERNLIYITVIDST

GKILEQRSLNTIQQFDYQKKLDNREKERVAARQAWSVVGTIKDLKQGYLSQVIHEIVDLMIHYQ

AVVVLENLNFGFKSRTGIAEKAVYQQFEKMLIDKLNCLVLKDYPAEKVGGVLNPYQLTDQFTS

FAKMGTQSGFLFYVPAPYTSKIDPLTGFVDPFVWKTIKNHESRKHFLEGFDFLHYDVKTGDFILH

FKMNRNLSFQRGLPGFMPAWDIVFEKNETQFDAKGTPFIAGKRIVPVIENHRFTGRYRDLYPANE

LIALLEEKGIVFRDGSNILPKLLENDDSHAIDTMVALIRSVLQMRNSNAATGEDYINSPVRDLNGV

CFDSRFQNPEWPMDADANGAYHIALKGQLLLNHLKESKDLKLQNGISNQDWLAYIQELRN*KRP*

*AATKKAGQAKKKKGS*YPYDVPDYAYPYDVPDYAYPYDVPDYA

9- Lachnospiraceae bacterium MA2020 (Lb2Cpf1)

(SEQ ID NO: 237)

MYYESLTKQYPVSKTIRNELIPIGKTLDNIRQNNILESDVKRKQNYEHVKGILDEYHKQLINEALD

NCTLPSLKIAAEIYLKNQKEVSDREDFNKTQDLLRKEVVEKLKAHENFTKIGKKDILDLLEKLPSI

SEDDYNALESFRNFYTYFTSYNKVRENLYSDKEKSSTVAYRLINENFPKFLDNVKSYRFVKTAGI

LADGLGEEEQDSLFIVETFNKTLTQDGIDTYNSQVGKINSSINLYNQKNQKANGFRKIPKMKMLY

KQILSDREESFIDEFQSDEVLIDNVESYGSVLIESLKSSKVSAFFDALRESKGKNVYVKNDLAKTA

MSNIVFENWRTFDDLLNQEYDLANENKKKDDKYFEKRQKELKKNKSYSLEHLCNLSEDSCNLIE

NYIHQISDDIENIIINNETFLRIVINEHDRSRKLAKNRKAVKAIKDFLDSIKVLERELKLINSSGQELE

KDLIVYSAHEELLVELKQVDSLYNMTRNYLTKKPFSTEKVKLNFNRSTLLNGWDRNKETDNLG

VLLLKDGKYYLGIMNTSANKAFVNPPVAKTEKVFKKVDYKLLPVPNQMLPKVFFAKSNIDFYNP

SSEIYSNYKKGTHKKGNMFSLEDCHNLIDFFKESISKHEDWSKFGFKFSDTASYNDISEFYREVEK

QGYKLTYTDIDETYINDLIERNELYLFQIYNKDF SMYSKGKLNLHTLYFMMLFDQRNIDDVVYK

LNGEAEVFYRPASISEDELIIHKAGEEIKNKNPNRARTKETSFSYDIVKDKRYSKDKFTLHIPITM

NFGVDEVKRFNDAVNSAIRIDENVNVIGIDRGERNLLYVVVIDSKGNILEQISLNSIINKEYDIETD

YHALLDEREGGRDKARKDWNTVENIRDLKAGYLSQVVNVVAKLVLKYNAIICLEDLNFGFKRG

RQKVEKQVYQKFEKMLIDKLNYLVIDKSREQTSPKELGGALNALQLTSKFKSFKELGKQSGVIY

YVPAYLTSKIDPTTGFANLFYMKCENVEKSKRFFDGFDFIRFNALENVFEFGFDYRSFTQRACGIN

SKWTVCTNGERIIKYRNPDKNNMFDEKVVVVTDEMKNLFEQYKIPYEDGRNVKDMIISNEEAEF

YRRLYRLLQQTLQMRNSTSDGTRDYIISPVKNKREAYFNSELSDGSVPKDADANGAYNIARKGL

WVLEQIRQKSEGEKINLAMTNAEWLEYAQTHLL*KRPAATKKAGQAKKKKGS*YPYDVPDYAYPY

DVPDYAYPYDVPDYA

10- Candidatus Methanoplasma termitum (CMtCpf1)

(SEQ ID NO: 238)

MNNYDEFTKLYPIQKTIRFELKPQGRTMEHLETFNFFEEDRDRAEKYKILKEAIDEYHKKFIDEHL

TNMSLDWNSLKQISEKYYKSREEKDKKVFLSEQKRMRQEIVSEFKKDDRFKDLFSKKLFSELLK

EEIYKKGNHQEIDALKSFDKFSGYFIGLHENRKNMYSDGDEITAISNRIVNENFPKFLDNLQKYQE

ARKKYPEWIIKAESALVAHNIKMDEVFSLEYFNKVLNQEGIQRYNLALGGYVTKSGEKMMGLN

DALNLAHQSEKSSKGRIHMTPLFKQILSEKESFSYIPDVFTEDSQLLPSIGGFFAQIENDKDGNIFD

RALELISSYAEYDTERIYIRQADINRVSNVIFGEWGTLGGLMREYKADSINDINLERTCKKVDKW

LDSKEFALSDVLEAIKRTGNNDAFNEYISKMRTAREKIDAARKEMKFISEKISGDEESIHIIKTLLD

SVQQFLHFFNLFKARQDIPLDGAFYAEFDEVHSKLFAIVPLYNKVRNYLTKNNLNTKKIKLNFKN

PTLANGWDQNKVYDYASLIFLRDGNYYLGIINPKRKKNIKFEQGSGNGPFYRKMVYKQIPGPNK

NLPRVFLTSTKGKKEYKPSKEIIEGYEADKHIRGDKFDLDFCHKLIDFFKESIEKHKDWSKFNFYF

SPTESYGDISEFYLDVEKQGYRMHFENISAETIDEYVEKGDLFLFQIYNKDFVKAATGKKDMHTI

YWNAAFSPENLQDVVVKLNGEAELFYRDKSDIKEIVHREGEILVNRTYNGRTPVPDKIHKKLTD

YHNGRTKDLGEAKEYLDKVRYFKAHYDITKDRRYLNDKIYFHVPLTLNFKANGKKNLNKMVIE

```
KFLSDEKAHIIGIDRGERNLLYYSIIDRSGKIIDQQSLNVIDGFDYREKLNQREIEMKDARQSWNAI

GKIKDLKEGYLSKAVHEITKMAIQYNAIVVMEELNYGFKRGRFKVEKQIYQKFENMLIDKMNYL

VFKDAPDESPGGVLNAYQLTNPLESFAKLGKQTGILFYVPAAYTSKIDPTTGFVNLFNTSSKTNA

QERKEFLQKFESISYSAKDGGIFAFAFDYRKFGTSKTDHKNVWTAYTNGERMRYIKEKKRNELF

DPSKEIKEALTSSGIKYDGGQNILPDILRSNNNGLIYTMYSSFIAAIQMRVYDGKEDYIISPIKNSKG

EFFRTDPKRRELPIDADANGAYNIALRGELTMRAIAEKFDPDSEKMAKLELKHKDWFEFMQTRG

DKRPAATKKAGQAKKKKGSYPYDVPDYAYPYDVPDYAYPYDVPDYA
```
11- Eubacterium eligens (EeCpf1)
(SEQ ID NO: 239)
```
MNGNRSIVYREFVGVIPVAKTLRNELRPVGHTQEHIIQNGLIQEDELRQEKSTELKNIMDDYYRE

YIDKSLSGVTDLDFTLLFELMNLVQSSPSKDNKKALEKEQSKMREQICTHLQSDSNYKNIFNAKL

LKEILPDFIKNYNQYDVKDKAGKLETLALFNGFSTYFTDFFEKRKNVFTKEAVSTSIAYRIVHENS

LIFLANMTSYKKISEKALDEIEVIEKNNQDKMGDWELNQIFNPDFYNMVLIQSGIDFYNEICGVV

NAHMNLYCQQTKNNYNLFKMRKLHKQILAYTSTSFEVPKMFEDDMSVYNAVNAFIDETEKGNI

IGKLKDIVNKYDELDEKRIYISKDFYETLSCFMSGNWNLITGCVENFYDENIHAKGKSKEEKVKK

AVKEDKYKSINDVNDLVEKYIDEKERNEFKNSNAKQYIREISNIITDTETAHLEYDDHISLIESEEK

ADEMKKRLDMYMNMYHWAKAFIVDEVLDRDEMFYSDIDDIYNILENIVPLYNRVRNYVTQKP

YNSKKIKLNFQSPTLANGWSQSKEFDNNAIILIRDNKYYLAIFNAKNKPDKKIIQGNSDKKNDND

YKKMVYNLLPGANKMLPKVFLSKKGIETFKPSDYIISGYNAHKHIKTSENFDISFCRDLIDYFKNS

IEKHAEWRKYEFKFSATDSYSDISEFYREVEMQGYRIDWTYISEADINKLDEEGKIYLFQIYNKDF

AENSTGKENLHTMYFKNIF SEENLKDIIIKLNGQAELFYRRASVKNPVKHKKD SVLVNKTYKNQ

LDNGDVVRIPIPDDIYNEIYKMYNGYIKESDLSEAAKEYLDKVEVRTAQKDIVKDYRYTVDKYFI

HTPITINYKVTARNNVNDMVVKYIAQNDDIHVIGIDRGERNLIYISVIDSHGNIVKQKSYNILNNY

DYKKKLVEKEKTREYARKNWKSIGNIKELKEGYISGVVHEIAMLIVEYNAIIAMEDLNYGFKRG

RFKVERQVYQKFESMLINKLNYFASKEKSVDEPGGLLKGYQLTYVPDNIKNLGKQCGVIFYVPA

AFTSKIDPSTGFISAFNFKSISTNASRKQFFMQFDEIRYCAEKDMFSFGFDYNNFDTYNITMGKTQ

WTVYTNGERLQSEFNNARRTGKTKSINLTETIKLLLEDNEINYADGHDIRIDMEKMDEDKKSEFF

AQLLSLYKLTVQMRNSYTEAEEQENGISYDKIISPVINDEGEFFDSDNYKESDDKECKMPKDADA

NGAYCIALKGLYEVLKIKSEWTEDGFDRNCLKLPHAEWLDFIQNKRYEKRPAATKKAGQAKKKK

GSYPYDVPDYAYPYDVPDYAYPYDVPDYA
```
12- Moraxella bovoculi 237 (MbCpf1)
(SEQ ID NO: 240)
```
MLFQDFTHLYPLSKTVRFELKPIDRTLEHIHAKNFLSQDETMADMHQKVKVILDDYHRDFIADM

MGEVKLTKLAEFYDVYLKFRKNPKDDELQKQLKDLQAVLRKEIVKPIGNGGKYKAGYDRLFGA

KLFKDGKELGDLAKFVIAQEGESSPKLAHLAHFEKFSTYFTGFHDNRKNMYSDEDKHTAIAYRLI

HENLPRFIDNLQILTTIKQKHSALYDQIINELTASGLDVSLASHLDGYHKLLTQEGITAYNTLLGGI

SGEAGSPKIQGINELINSHHNQHCHKSERIAKLRPLHKQILSDGMSVSFLPSKFADDSEMCQAVNE

FYRHYADVFAKVQSLFDGFDDHQKDGIYVEHKNLNELSKQAFGDFALLGRVLDGYYVDVVNPE

FNERFAKAKTDNAKAKLTKEKDKFIKGVHSLASLEQAIEHYTARHDDESVQAGKLGQYFKHGL

AGVDNPIQKIHNNHSTIKGFLERERPAGERALPKIKSGKNPEMTQLRQLKELLDNALNVAHFAKL

LTTKTTLDNQDGNFYGEFGVLYDELAKIPTLYNKVRDYLSQKPFSTEKYKLNFGNPTLLNGWDL

NKEKDNFGVILQKDGCYYLALLDKAHKKVFDNAPNTGKSIYQKMIYKYLEVRKQFPKVFFSKE

AIAINYHPSKELVEIKDKGRQRSDDERLKLYRFILECLKIHPKYDKKFEGAIGDIQLFKKDKKGRE

VPISEKDLFDKINGIFSSKPKLEMEDFFIGEFKRYNPSQDLVDQYNIYKKIDSNDNRKKENFYNNH
```

-continued

PKFKKDLVRYYYESMCKHEEWEESFEFSKKLQDIGCYVDVNELFTEIETRRLNYKISFCNINADYI
DELVEQGQLYLFQIYNKDFSPKAHGKPNLHTLYFKALFSEDNLADPIYKLNGEAQIFYRKASLDM
NETTIHRAGEVLENKNPDNPKKRQFVYDIIKDKRYTQDKFMLHVPITMNFGVQGMTIKEFNKKV
NQSIQQYDEVNVIGIDRGERHLLYLTVINSKGEILEQCSLNDITTASANGTQMTTPYHKILDKREIE
RLNARVGWGEIETIKELKSGYLSHVVHQISQLMLKYNAIVVLEDLNFGFKRGRFKVEKQIYQNFE
NALIKKLNHLVLKDKADDEIGSYKNALQLTNNFTDLKSIGKQTGFLFYVPAWNTSKIDPETGFVD
LLKPRYENIAQSQAFFGKFDKICYNADKDYFEFHIDYAKFTDKAKNSRQIWTICSHGDKRYVYD
KTANQNKGAAKGINVNDELKSLFARHHINEKQPNLVMDICQNNDKEFHKSLMYLLKTLLALRY
SNASSDEDFILSPVANDEGVFFNSALADDTQPQNADANGAYHIALKGLWLLNELKNSDDLNKVK
LAIDNQTWLNFAQNR*KRPAATKKAGQAKKKK*GSYPYDVPDYAYPYDVPDYAYPYDVPDYA

13- Leptospira inadai (LiCpfl)

(SEQ ID NO: 241)

MEDYSGFVNIYSIQKTLRFELKPVGKTLEHIEKKGFLKKDKIRAEDYKAVKKIIDKYHRAYIEEVF
DSVLHQKKKDKTRFSTQFIKEIKEFSELYYKTEKNIPDKERLEALSEKLRKMLVGAFKGEFSEE
VAEKYKNLFSKELIRNEIEKFCETDEERKQVSNFKSFTTYFTGFHSNRQNIYSDEKKSTAIGYRIIH
QNLPKFLDNLKIIESIQRRFKDFPWSDLKKNLKKIDKNIKLTEYFSIDGFVNVLNQKGIDAYNTILG
GKSEESGEKIQGLNEYINLYRQKNNIDRKNLPNVKILFKQILGDRETKSFIPEAFPDDQSVLNSITE
FAKYLKLDKKKKSIIAELKKFLSSFNRYELDGIYLANDNSLASISTFLFDDWSFIKKSVSFKYDESV
GDPKKKIKSPLKYEKEKEKWLKQKYYTISFLNDAIESYSKSQDEKRVKIRLEAYFAEFKSKDDAK
KQFDLLERIEEAYAIVEPLLGAEYPRDRNLKADKKEVGKIKDFLDSIKSLQFFLKPLLSAEIFDEKD
LGFYNQLEGYYEEIDSIGHLYNKVRNYLTGKIYSKEKFKLNFENSTLLKGWDENREVANLCVIFR
EDQKYYLGVMDKENNTILSDIPKVKPNELFYEKMVYKLIPTPHMQLPRIIFSSDNLSIYNPSKSILK
IREAKSFKEGKNFKLKDCHKFIDFYKESISKNEDWSRFDFKFSKTSSYENISEFYREVERQGYNLD
FKKVSKFYIDSLVEDGKLYLFQIYNKDF SIFSKGKPNLHTIYFRSLFSKENLKDVCLKLNGEAEMF
FRKKSINYDEKKKREGHHPELFEKLKYPILKDKRYSEDKFQFHLPISLNFKSKERLNFNLKVNEFL
KRNKDINIIGIDRGERNLLYLVMINQKGEILKQTLLDSMQ SGKGRPEINYKEKLQEKEIERDKARK
SWGTVENIKELKEGYLSIVIHQISKLMVENNAIVVLEDLNIGFKRGRQKVERQVYQKFEKMLIDK
LNFLVFKENKPTEPGGVLKAYQLTDEFQSFEKLSKQTGFLFYVPSWNTSKIDPRTGFIDFLHPAYE
NIEKAKQWINKFDSIRFNSKMDWFEFTADTRKFSENLMLGKNRVWVICTTNVERYFTSKTANSSI
QYNSIQITEKLKELFVDIPFSNGQDLKPEILRKNDAVFFKSLLFYIKTTLSLRQNNGKKGEEEKDFI
LSPVVDSKGRFFNSLEASDDEPKDADANGAYHIALKGLMNLLVLNETKEENLSRPKWKIKNKD
WLEFVWERNR*KRPAATKKAGQAKKKK*GSYPYDVPDYAYPYDVPDYAYPYDVPDYA

14- Lachnospiraceae bacterium ND2006 (LbCpfl)

(SEQ ID NO: 242)

MSKLEKFTNCYSLSKTLRFKAIPVGKTQENIDNKRLLVEDEKRAEDYKGVKKLLDRYYLSFIND
VLHSIKLKNLNNYISLFRKKTRTEKENKELENLEINRLKEIAKAFKGNEGYKSLFKKDIIETILPEFL
DDKDEIALVNSFNGFTTAFTGFFDNRENMF SEEAKSTSIAFRCINENLTRYISNMDIFEKVDAIFDK
HEVQEIKEKILNSDYDVEDFFEGEFFNFVLTQEGIDVYNAIIGGFVTESGEKIKGLNEYINLYNQKT
KQKLPKFKPLYKQVLSDRESLSFYGEGYTSDEEVLEVFRNTLNKNSEIFSSIKKLEKLFKNFDEYS
SAGIFVKNGPAISTISKDIFGEWNVIRDKWNAEYDDIHLKKKAVVTEKYEDDRRKSFKKIGSFSLE
QLQEYADADLSVVEKLKEIIIQKVDEIYKVYGSSEKLFDADFVLEKSLKKNDAVVAIMKDLLDSV
KSFENYIKAFFGEGKETNRDESFYGDFVLAYDILLKVDHIYDAIRNYVTQKPYSKDKFKLYFQNP
QFMGGWDKDKETDYRATILRYGSKYYLAIMDKKYAKCLQKIDKDDVNGNYEKINYKLLPGPN

-continued

KMLPKVFF SKKWMAYYNPSEDIQKIYKNGTFKKGDMFNLNDCHKLIDFFKDSISRYPKWSNAY

DFNFSETEKYKDIAGFYREVEEQGYKVSFESASKKEVDKLVEEGKLYMFQIYNKDFSDKSHGTP

NLHTMYFKLLFDENNHGQIRLSGGAELFMRRASLKKEELVVHPANSPIANKNPDNPKKTTTLSY

DVYKDKRFSEDQYELHIPIAINKCPKNIFKINTEVRVLLKHDDNPYVIGIDRGERNLLYIVVVDGK

GNIVEQYSLNEIINNFNGIRIKTDYHSLLDKKEKERFEARQNWTSIENIKELKAGYISQVVHKICEL

VEKYDAVIALEDLNSGFKNSRVKVEKQVYQKFEKMLIDKLNYMVDKKSNPCATGGALKGYQIT

NKFESFKSMSTQNGFIFYIPAWLTSKIDPSTGFVNLLKTKYTSIADSKKFISSFDRIMYVPEEDLFEF

ALDYKNFSRTDADYIKKWKLYSYGNRIRIFRNPKKNNVFDWEEVCLTSAYKELFNKYGINYQQG

DIRALLCEQSDKAFYSSFMALMSLMLQMRNSITGRTDVDFLISPVKNSDGIFYDSRNYEAQENAI

LPKNADANGAYNIARKVLWAIGQFKKAEDEKLDKVKIAISNKEWLEYAQTSVKH*KRPAATKKAG*

*QAKKKKGS*YPYDVPDYAYPYDVPDYAYPYDVPDYA

15- Porphyromonas crevioricanis (PcCpfl)

(SEQ ID NO: 243)

MDSLKDFTNLYPVSKTLRFELKPVGKTLENIEKAGILKEDEHRAESYRRVKKIIDTYHKVFIDSSL

ENMAKMGIENEIKAMLQSFCELYKKDHRTEGEDKALDKIRAVLRGLIVGAFTGVCGRRENTVQ

NEKYESLFKEKLIKEILPDFVLSTEAESLPFSVEEATRSLKEFDSFTSYFAGFYENRKNIYSTKPQST

AIAYRLIHENLPKFIDNILVFQKIKEPIAKELEHIRADFSAGGYIKKDERLEDIFSLNYYIHVLSQAGI

EKYNALIGKIVTEGDGEMKGLNEHINLYNQQRGREDRLPLFRPLYKQILSDREQLSYLPESFEKD

EELLRALKEFYDHIAEDILGRTQQLMTSISEYDLSRIYVRNDSQLTDISKKMLGDWNAIYMARER

AYDHEQAPKRITAKYERDRIKALKGEESISLANLNSCIAFLDNVRDCRVDTYLSTLGQKEGPHGL

SNLVENVFASYHEAEQLLSFPYPEENNLIQDKDNVVLIKNLLDNISDLQRFLKPLWGMGDEPDKD

ERFYGEYNYIRGALDQVIPLYNKVRNYLTRKPYSTRKVKLNFGNSQLLSGWDRNKEKDNSCVIL

RKGQNFYLAIMNNRHKRSFENKMLPEYKEGEPYFEKMDYKFLPDPNKMLPKVFLSKKGIEIYKP

SPKLLEQYGHGTHKKGDTFSMDDLHELIDFFKHSIEAHEDWKQFGFKFSDTATYENVSSFYREVE

DQGYKLSFRKVSESYVYSLIDQGKLYLFQIYNKDFSPCSKGTPNLHTLYWRMLFDERNLADVIY

KLDGKAEIFFREKSLKNDHPTHPAGKPIKKKSRQKKGEESLFEYDLVKDRRYTMDKFQPHVPIT

MNFKCSAGSKVNDMVNAHIREAKDMHVIGIDRGERNLLYICVIDSRGTILDQISLNTINDIDYFIDL

LESRDKDRQQEHRNWQTIEGIKELKQGYLSQAVHRIAELMVAYKAVVALEDLNMGFKRGRQK

VESSVYQQFEKQLIDKLNYLVDKKKRPEDIGGLLRAYQFTAPFKSFKEMGKQNGFLFYIPAWNT

SNIDPTTGFVNLFHVQYENVDKAKSFFQKFDSISYNPKKDWFEFAFDYKNFTKKAEGSRSMWIL

CTHGSRIKNFRNSQKNGQWDSEEFALTEAFKSLFVRYEIDYTADLKTAIVDEKQKDFFVDLLKLF

KLTVQMRNSWKEKDLDYLISPVAGADGRFFDTREGNKSLPKDADANGAYNIALKGLWALRQIR

QTSEGGKLKLAISNKEWLQFVQERSYEKD*KRPAATKKAGQAKKKKGS*YPYDVPDYAYPYDVPD

YAYPYDVPDYA

16- Prevotella disiens (PdCpfl)

(SEQ ID NO: 244)

MENYQEFTNLFQLNKTLRFELKPIGKTCELLEEGKIFASGSFLEKDKVRADNVSYVKKEI

DKKHKIFIEETLSSFSISNDLLKQYFDCYNELKAFKKDCKSDEEEVKKTALRNKCTSIQR

AMREAISQAFLKSPQKKLLAIKNLIENVFKADENVQHFSEFTSYFSGFETNRENFYSDEE

KSTSIAYRLVHDNLPIFIKNIYIFEKLKEQFDAKTLSEIFENYKLYVAGSSLDEVFSLEYFN

NTLTQKGIDNYNAVIGKIVKEDKQEIQGLNEHINLYNQKHKDRRLPFFISLKKQILSDREA

LSWLPDMFKNDSEVIKALKGFYIEDGFENNVLTPLATLLSSLDKYNLNGIFIRNNEALSSL

SQNVYRNFSIDEAIDANAELQTFNNYELIANALRAKIKKETKQGRKSFEKYEEYIDKKVK

```
AIDSLSIQEINELVENYVSEFNSNSGNMPRKVEDYFSLMRKGDFGSNDLIENIKTKLSAAE

KLLGTKYQETAKDIFKKDENSKLIKELLDATKQFQHFIKPLLGTGEEADRDLVFYGDFLP

LYEKFEELTLLYNKVRNRLTQKPYSKDKIRLCFNKPKLMTGWVDSKTEKSDNGTQYGG

YLFRKKNEIGEYDYF GISSKAQLFRKNEAVIGDYERLDYYQPKANTIYGSAYEGENSY

KEDKKRLNKVIIAYIEQIKQTNIKKSITESISKYPNISDDDKVTPSLLEKIKKVSIDSYNGIL

SFKSFQSVNKEVIDNLLKTISPLKNKAEFLDLINKDYQIFTEVQAVIDEICKQKTFIYFPISN

VELEKEMGDKDKPLCLFQISNKDLSFAKTFSANLRKKRGAENLHTMLFKALMEGNQDN

LDLGSGAIFYRAKSLDGNKPTHPANEAIKCRNVANKDKVSLFTYDIYKNRRYMENKFLF

HLSIVQNYKAANDSAQLNSSATEYIRKADDLHIIGIDRGERNLLYYSVIDMKGNIVEQDS

LNIIRNNDLETDYHDLLDKREKERKANRQNWEAVEGIKDLKKGYLSQAVHQIAQLMLK

YNAIIALEDLGQMFVTRGQKIEKAVYQQFEKSLVDKLSYLVDKKRPYNELGGILKAYQL

ASSITKNNSDKQNGFLFYVPAWNTSKIDPVTGFTDLLRPKAMTIKEAQDFFGAFDNISYN

DKGYFEFETNYDKFKIRMKSAQTRWTICTFGNRIKRKKDKNYWNYEEVELTEEFKKLF

KDSNIDYENCNLKEEIQNKDNRKFFDDLIKLLQLTLQMRNSDDKGNDYIISPVANAEGQF

FDSRNGDKKLPLDADANGAYNIARKGLWNIRQIKQTKNDKKLNLSISSTEWLDFVREKP

YLKKRPAATKKAGQAKKKKGSYPYDVPDYAYPYDVPD AYPYDVPDYA

17- Porphyromonas macacae (PmCpf1)
                                                  (SEQ ID NO: 245)
MKTQHFFEDFTSLYSLSKTIRFELKPIGKTLENIKKNGLIRRDEQRLDDYEKLKKVIDEYHEDFIAN

ILS SFSFSEEILQSYIQNLSESEARAKIEKTMRDTLAKAFSEDERYKSIFKKELVKKDIPVWCPAYK

SLCKKFDNFTTSLVPFHENRKNLYTSNEITASIPYRIVHVNLPKFIQNIEALCELQKKMGADLYLE

MMENLRNVWPSFVKTPDDLCNLKTYNHLMVQSSISEYNRFVGGYSTEDGTKHQGINEWINIYR

QRNKEMRLPGLVFLHKQILAKVDSSSFISDTLENDDQVFCVLRQFRKLFWNTVSSKEDDAASLK

DLFCGLSGYDPEAIYVSDAHLATISKNIFDRWNYISDAIRRKTEVLMPRKKESVERYAEKISKQIK

KRQSYSLAELDDLLAHYSEESLPAGFSLLSYFTSLGGQKYLVSDGEVILYEEGSNIWDEVLIAFRD

LQVILDKDFTEKKLGKDEEAVSVIKKALDSALRLRKFFDLLSGTGAEIRRDSSFYALYTDRMDKL

KGLLKMYDKVRNYLTKKPYSIEKFKLHFDNPSLLSGWDKNKELNNLSVIFRQNGYYYLGIMTPK

GKNLFKTLPKLGAEEMFYEKMEYKQIAEPMLMLPKVFFPKKTKPAFAPDQSVVDIYNKKTFKTG

QKGFNKKDLYRLIDFYKEALTVHEWKLFNFSFSPTEQYRNIGEFFDEVREQAYKVSMVNVPASYI

DEAVENGKLYLFQIYNKDFSPYSKGIPNLHTLYWKALFSEQNQSRVYKLCGGGELFYRKASLHM

QDTTVHPKGISIHKKNLNKKGETSLFNYDLVKDKRFTEDKFFFHVPISINYKNKKITNVNQMVRD

YIAQNDDLQIIGIDRGERNLLYISRIDTRGNLLEQFSLNVIESDKGDLRTDYQKILGDREQERLRRR

QEWKSIESIKDLKDGYMSQVVHKICNMVVEHKAIVVLENLNLSFMKGRKKVEKSVYEKFERML

VDKLNYLVVDKKNLSNEPGGLYAAYQLTNPLFSFEELHRYPQSGILFFVDPWNTSLTDPSTGFVN

LLGRINYTNVGDARKFFDRFNAIRYDGKGNILFDLDLSRFDVRVETQRKLWTLTTFGSRIAKSKK

SGKWMVERIENLSLCFLELFEQFNIGYRVEKDLKKAILSQDRKEFYVRLIYLFNLMMQIRNSDGE

EDYILSPALNEKNLQFDSRLIEAKDLPVDADANGAYNVARKGLMVVQRIKRGDHESIHRIGRAQ

WLRYVQEGIVEKRPAATKKAGQAKKKKGSYPYDVPDYAYPYDVPDYAYPYDVPDYA
```

Example 15: Computational Analysis of the Cpf1 Structure

Computational analysis of the primary structure of Cpf1 nucleases reveals three distinct regions (FIG. 72). First a C-terminal RuvC like domain, which is the only functional characterized domain. Second a N-terminal alpha-helical region and thirst a mixed alpha and beta region, located between the RuvC like domain and the alpha-helical region.

Several small stretches of unstructured regions are predicted within the Cpf1 primary structure. Unstructured regions, which are exposed to the solvent and not conserved within different Cpf1 orthologs, are preferred sides for splits and insertions of small protein sequences. In addition, these sides can be used to generate chimeric proteins between Cpf1 orthologs.

Example 16: Generation of Cpf1 Mutants with Enhanced Specificity

Recently a method was described for the generation of Cas9 orthologs with enhanced specificity (Slaymaker et al. 2015). This strategy can be used to enhance the specificity of Cpf1 orthologs. Primay residues for mutagenesis are all positive charges residues within the RuvC domain, since this is the only known structure in the absence of a crystal and we know that specificity mutants in RuvC worked in Cas9 (see Table below: Conserved Lysine and Arginine residues within RuvC).

Table: Conserved Lysine and Arginine residues within RuvC.

TABLE

Conserved Lysine and Arginine residues within RuvC.

| AsCpf1 | LbCpf1 |
| --- | --- |
| R912 | R833 |
| T923 | R836 |
| R947 | K847 |
| K949 | K879 |
| R951 | K881 |
| R955 | R883 |
| K965 | R887 |
| K968 | K897 |
| K1000 | K900 |
| R1003 | K932 |
| K1009 | R935 |
| K1017 | K940 |
| K1022 | K948 |
| K1029 | K953 |
| K1072 | K960 |
| K1086 | K984 |
| F1103 | K1003 |
| R1226 | K1017 |
| R1252 | R1033 |
|  | R1138 |
|  | R1165 |

Additional candidates are positive charged residues that are conserved between different orthologs are provided in the Table below.

TABLE

Conserved Lysine and Arginine residues

| Residue | AsCpf1 | FnCpf1 | LbCpf1 | MbCpf1 |
| --- | --- | --- | --- | --- |
| Lys | K15 | K15 | K15 | K14 |
| Arg | R18 | R18 | R18 | R17 |
| Lys/Arg | K26 | K26 | K26 | R25 |
| Lys/Arg | Q34 | R34 | K34 | K33 |
| Arg | R43 | R43 | R43 | M42 |
| Lys | K48 | K48 | K48 | Q47 |
| Lys | K51 | K51 | K51 | K50 |
| Lys/Arg | R56 | K56 | R56 | D55 |
| Lys/Arg | R84 | K87 | K83 | K85 |
| Lys/Arg | K85 | K88 | K84 | N86 |
| Lys/Arg | K87 | D90 | R86 | K88 |
| Arg | N93 | N96 | N92 | K94 |
| Lys/Arg | R103 | K106 | R102 | R104 |
| Lys | N104 | K107 | K103 | K105 |
| Lys | T118 | K120 | K116 | K118 |
| Lys/Arg | K123 | Q125 | K121 | K123 |
| Lys | K134 | K143 | — | K131 |

TABLE-continued

Conserved Lysine and Arginine residues

| Residue | AsCpf1 | FnCpf1 | LbCpf1 | MbCpf1 |
| --- | --- | --- | --- | --- |
| Arg | R176 | R186 | R158 | R174 |
| Lys | K177 | K187 | E159 | K175 |
| Arg | R192 | R202 | R174 | R190 |
| Lys/Arg | K200 | K210 | R182 | R198 |
| Lys | K226 | K235 | K206 | I221 |
| Lys | K273 | K296 | K251 | K267 |
| Lys | K275 | K298 | K253 | Q269 |
| Lys | T291 | K314 | K269 | K285 |
| Lys/Arg | R301 | K320 | K271 | K291 |
| Lys | K307 | K326 | K278 | K297 |
| Lys | K369 | K397 | P342 | K357 |
| Lys | S404 | K444 | K380 | K403 |
| Lys/Arg | V409 | K449 | R385 | K409 |
| Lys | K414 | E454 | K390 | K414 |
| Lys | K436 | A483 | K415 | K448 |
| Lys | K438 | E491 | K421 | K460 |
| Lys | K468 | K527 | K457 | K501 |
| Lys | D482 | K541 | K471 | K515 |
| Lys | K516 | K581 | A506 | K550 |
| Arg | R518 | R583 | R508 | R552 |
| Lys | K524 | K589 | K514 | K558 |
| Lys | K530 | K595 | K520 | K564 |
| Lys | K532 | K597 | K522 | K566 |
| Lys | K548 | K613 | K538 | K582 |
| Lys | K559 | K624 | Y548 | K593 |
| Lys | K570 | K635 | K560 | K604 |
| Lys/Arg | R574 | K639 | K564 | K608 |
| Lys | K592 | K656 | K580 | K623 |
| Lys | D596 | K660 | K584 | K627 |
| Lys | K603 | K667 | K591 | K633 |
| Lys | K607 | K671 | K595 | K637 |
| Lys | K613 | K677 | K601 | E643 |
| Lys | C647 | K719 | K634 | K780 |
| Lys/Arg | R681 | K725 | K640 | Y787 |
| Lys/Arg | K686 | K730 | R645 | K792 |
| Lys | H720 | K763 | K679 | K830 |
| Lys | K739 | K782 | K689 | Q846 |
| Lys | K748 | K791 | K707 | K858 |
| Lys/Arg | K757 | R800 | T716 | K867 |
| Lys/Arg | T766 | K809 | K725 | K876 |
| Lys/Arg | K780 | K823 | R737 | K890 |
| Arg | R790 | R833 | R747 | R900 |
| Lys/Arg | P791 | K834 | R748 | K901 |
| Lys | K796 | K839 | K753 | M906 |
| Lys | K809 | K852 | K768 | K921 |
| Lys | K815 | K858 | K774 | K927 |
| Lys | T816 | K859 | K775 | K928 |
| Lys | K860 | K869 | K785 | K937 |
| Lys/Arg | R862 | K871 | K787 | K939 |
| Arg | R863 | R872 | R788 | R940 |
| Lys | K868 | K877 | Q793 | K945 |
| Lys | K897 | K905 | K821 | Q975 |
| Arg | R909 | R918 | R833 | R987 |
| Arg | R912 | R921 | R836 | R990 |
| Lys | T923 | K932 | K847 | K1001 |
| Lys/Arg | R947 | I960 | K879 | R1034 |
| Lys | K949 | K962 | K881 | I1036 |
| Arg | R951 | R964 | R883 | R1038 |
| Arg | R955 | R968 | R887 | R1042 |
| Lys | K965 | K978 | K897 | K1052 |
| Lys | K968 | K981 | K900 | K1055 |
| Lys | K1000 | K1013 | K932 | K1087 |
| Arg | R1003 | R1016 | R935 | R1090 |
| Lys | K1009 | K1021 | K940 | K1095 |
| Lys | K1017 | K1029 | K948 | N1103 |
| Lys | K1022 | K1034 | K953 | K1108 |
| Lys | K1029 | K1041 | K960 | K1115 |
| Lys | A1053 | K1065 | K984 | K1139 |
| Lys | K1072 | K1084 | K1003 | K1158 |
| Lys/Arg | K1086 | K1098 | K1017 | R1172 |
| Lys/Arg | F1103 | K1114 | R1033 | K1188 |

TABLE-continued

Conserved Lysine and Arginine residues

| Residue | AsCpf1 | FnCpf1 | LbCpf1 | MbCpf1 |
|---|---|---|---|---|
| Lys | S1209 | K1201 | K1121 | K1276 |
| Arg | R1226 | R1218 | R1138 | R1293 |
| Arg | R1252 | R1244 | R1165 | A1319 |
| Lys | K1273 | K1265 | K1190 | K1340 |
| Lys | K1282 | K1274 | K1199 | K1349 |
| Lys | K1288 | K1281 | K1208 | K1356 |

The Table above provides the positions of conserved Lysine and Arginine residues in an alignment of Cpf1 nuclease from *Francisella novicida* U112 (FnCpf1), *Acidaminococcus* sp. BV3L,6 (AsCpf1), *Lachnospiraceae bacterium* ND2006 (LbCpf1) and *Moraxella bovoculi* 237 (MbCpf1). These can be used to generate Cpf1 mutants with enhanced specificity.

Example 17: Improving Specificity of Cpf1 Binding

With a similar strategy used to improve Cas9 specificity, specificity of Cpf1 can be improved by mutating residues that stabilize the non-targeted DNA strand. This may be accomplished without a crystal structure by using linear structure alignments to predict 1) which domain of Cpf1 binds to which strand of DNA and 2) which residues within these domains contact DNA.

However, this approach may be limited due to poor conservation of Cpf1 with known proteins. Thus it may be desirable to probe the function of all likely DNA interacting amino acids (lysine, histidine and arginine).

Positively charged residues in the RuvC domain are more conserved throughout Cpf1s than those in the Rad50 domain indicating that RuvC residues are less evolutionarily flexible. This suggests that rigid control of nucleic acid binding is needed in this domain (relative to the Rad50 domain). Therefore, it is possible this domain cuts the targeted DNA strand because of the requirement for RNA:DNA duplex stabilization (precedent in Cas9). Furthermore, more arginines are present in the RuvC domain (5% of RuvC residues 904 to 1307 vs 3.8% in the proposed Rad50 domains) suggesting again that RuvC targets one of the DNA strands. Arginines are more involved in binding nucleic acid major and minor grooves (Rohs Nature 2009: rohslab.cmb.usc.edu/Papers/Rohs_etal_Nature.pdf). Major/minor grooves would only be present in a duplex (such as DNA:RNA targeting duplex), further suggesting that RuvC may be involved in cutting.

FIGS. 73, 74 and 75 and provide crystal structures of two similar domains as those found in Cpf1 (RuvC holiday junction resolvase and Rad50 DNA repair protein). Based on these structures, it can be deduced what the relevant domains look like in Cpf1, and infer which regions and residues may contact DNA. In each structure residues are highlighted that contact DNA. In the alignments in FIG. 76 the regions of AsCpf1 that correspond to these DNA binding regions are annotated. The list of residues in Table below are those found in the two binding domains.

TABLE list of probable DNA interacting residues

| RuvC domain probable DNA interacting residues: AsCpf1 | Rad50 domain probable DNA interacting residues: AsCpf1 |
|---|---|
| R909 | K324 |
| R912 | K335 |
| R930 | K337 |
| R947 | R331 |
| K949 | K369 |
| R951 | K370 |
| R955 | R386 |
| K965 | R392 |
| K968 | R393 |
| K1000 | K400 |
| K1002 | K404 |
| R1003 | K406 |
| K1009 | K408 |
| K1017 | K414 |
| K1022 | K429 |
| K1029 | K436 |
| K1035 | K438 |
| K1054 | K459 |
| K1072 | K460 |
| K1086 | K464 |
| R1094 | R670 |
| K1095 | K675 |
| K1109 | R681 |
| K1118 | K686 |
| K1142 | K689 |
| K1150 | R699 |
| K1158 | K705 |
| K1159 | R725 |
| R1220 | K729 |
| R1226 | K739 |
| R1242 | K748 |
| R1252 | K752 |
|  | R670 |

From these specific observations about AsCpf1 we can identify similar residues in Cpf1 from other species by sequence alignments. Example given in FIG. 77 of AsCpf1 and FnCpf1 aligned, identifying Rad50 binding domains and the Arginines and Lysines within.

Example 18: Multiplexing with Cpf1 Using Tandem Guides

It was considered whether multiplexing is possible with the Cpf1 enzyme. For this purpose, guide RNAs were developed whereby different guide sequences were positioned in tandem under the same promoter, and the ability of these guides to direct genome editing to their respective targets was determined.

150,000 HEK293T cells were plated per 24-well 24h before transfection. Cells were transfected with 400 ng huAsCpf1 plasmid and 100 ng of tandem guide plasmid comprising one guide sequence directed to GRIN28 and one directed to EMX1 placed in tandem behind the U6 promoter (FIG. 78A), using Lipofectamin2000. Cells were harvested 72h after transfection and AsCpf1 activity mediated by tandem guides was assayed using the SURVEYOR nuclease assay.

The results are demonstrated in FIG. 78B, which demonstrates INDEL formation in both the GRIN28 and the EMX1 gene.

It was thus determined that AsCpf1 and by analogy LbCpf1 can employ two guides expressed from the same U6 promoter without loss in activity. The position within the tandem has no influence on the indel formation. This demonstrated that Cpf1 can be used for multiplexing using two or more guides.

Example 19: Cpf1 can be Harnessed to Generate Optimized Functional CRISPR-Cas Systems In view of the relative simplicity of the Cpf1 enzyme, it was investigated whether this enzyme could also be harnessed to generate functional CRISPR-Cas systems.

The functional CRISPR-Cas systems developed comprises a guide modified by the insertion of distinct RNA sequence that binds to an adaptor proteins. The MS2 aptamer was used for binding to the MS2 adaptor protein.

Synthesizing AsCpf1 and LbCpf1 Guides with MS2 at Different Locations

AsCpf1 and LbCpf1 guide RNAs were generated containing one of 5 different spacers targeting the human HBG1, as listed below in the Table below. Each spacer comprises a TTTN PAM sequence.

TABLE

Spacers targeting human HBG1 (represented with corresponding PAM sequence)

| No. | Sequence | SEQ ID No. |
|---|---|---|
| HBG1.3 | tttagccagggaccgtttcagaca | 31 |
| HBG1.4 | tttgccttgtcaaggctattggtc | 32 |
| HBG1.5 | tttattcttcatccctagccagcc | 33 |
| HBG1.6 | ttttattcttcatccctagccagc | 34 |
| HBG1.7 | tttcacagaggaggacaaggctac | 35 |

The spacers were synthesized using Kapa HI-FI, a template plasmid PX330 (because this plasmid contains a U6 promotor), a universal U6 forward primer and a reverse primer that is unique for each sequence.

AsCpf1 and LbCpf1 guide RNAs were successfully established by PCR. All guide RNAs comprise a U6 handle 5' of the direct repeat (sequence: cttgtggaaaggacgaaacacc (SEQ ID NO. 251).

The sequence of the guide RNA's is represented in the Table below. The guide RNA's either contained (a) no MS2 loops (guide RNA No. 1, 5, 9, 13, 17, 21, 25, 29, 33 and 37), (b) an MS2 loop introduced 5' of the direct repeat (guide RNA No. 2, 6, 10, 14, 18, 22, 26, 30, 34 and 38), (c) an MS2 loop introduced within the direct repeat sequence (guide RNA No. 3, 7, 11, 15, 19, 23, 27, 31, 35 and 39), or (d) an MS2 loop 3' of the spacer (guide RNA No. 4, 8, 12, 16, 20, 24, 28, 32, 36 and 40).

TABLE

Guide RNAs generated

| No. | Description | Sequence | SEQ ID No. |
|---|---|---|---|
| 1 | No MS2 (1.3) As | cttgtggaaaggacgaaacaccGTAATTTCTACTCTTGTAGATgccagggaccgtttcagaca | 36 |
| 2 | 5'MS2 (1.3) As | cttgtggaaaggacgaaacaccGGGCCAACATGAGGATCACCCATGTCTGCAGGGCCAGTAATTTCTACTCTTGTAGATgccagggaccgtttcagaca | 37 |
| 3 | IntMS2 (1.3) As | cttgtggaaaggacgaaacaccGTAATTTCTACTGGCCAACATGAGGATCACCCATGTCTGCAGGGCCAGCTTGTAGATgccagggaccgtttcagaca | 38 |
| 4 | 3'MS2 (1.3) As | cttgtggaaaggacgaaacaccGTAATTTCTACTCTTGTAGATgccagggaccgtttcagacaGGCCAACATGAGGATCACCCATGTCTGCAGGGCCAG | 39 |
| 5 | No MS2 (1.4) As | cttgtggaaaggacgaaacaccGTAATTTCTACTCTTGTAGATccttgtcaaggctattggtc | 40 |
| 6 | 5'MS2 (1.4) As | cttgtggaaaggacgaaacaccGGGCCAACATGAGGATCACCCATGTCTGCAGGGCCAGTAATTTCTACTCTTGTAGATccttgtcaaggctattggtc | 41 |
| 7 | IntMS2 (1.4) As | cttgtggaaaggacgaaacaccGTAATTTCTACTGGCCAACATGAGGATCACCCATGTCTGCAGGGCCAGCTTGTAGATccttgtcaaggctattggtc | 42 |
| 8 | 3'MS2 (1.4) As | cttgtggaaaggacgaaacaccGTAATTTCTACTCTTGTAGATccttgtcaaggctattggtcGGCCAACATGAGGATCACCCATGTCTGCAGGGCCAG | 43 |
| 9 | No MS2 (1.5) As | cttgtggaaaggacgaaacaccGTAATTTCTACTCTTGTAGATttcttcatccctagccagcc | 44 |
| 10 | 5'MS2 (1.5) As | cttgtggaaaggacgaaacaccGGGCCAACATGAGGATCACCCATGTCTGCAGGGCCAGTAATTTCTACTCTTGTAGATttcttcatccctagccagcc | 45 |

TABLE-continued

Guide RNAs generated

| No. | Description | Sequence | SEQ ID No. |
|---|---|---|---|
| 11 | IntMS2(1.5)As | cttgtggaaaggacgaaacaccGTAATTTCTACTGGCCAACATGA GGATCACCCATGTCTGCAGGGCCAGCTTGTAGATtttcttc atccctagccagcc | 46 |
| 12 | 3'MS2(1.5)As | cttgtggaaaggacgaaacaccGTAATTTCTACTCTTGTAGATtttctt catccctagccagccGGCCAACATGAGGATCACCCATGTCTG CAGGGCCAG | 47 |
| 13 | No MS2(1.6)As | cttgtggaaaggacgaaacaccGTAATTTCTACTCTTGTAGATattc ttcatccctagccagc | 48 |
| 14 | 5'MS2(1.6)As | cttgtggaaaggacgaaacaccGGCCAACATGAGGATCACCCA TGTCTGCAGGGCCAGTAATTTCTACTCTTGTAGATattct tcatccctagccagc | 50 |
| 15 | IntMS2(1.6)As | cttgtggaaaggacgaaacaccGTAATTTCTACTGGCCAACATGA GGATCACCCATGTCTGCAGGGCCAGCTTGTAGATattctt catccctagccagc | 53 |
| 16 | 3'MS2(1.6)As | cttgtggaaaggacgaaacaccGTAATTTCTACTCTTGTAGATattc ttcatccctagccagcGGCCAACATGAGGATCACCCATGTCTG CAGGGCCAG | 54 |
| 17 | No MS2(1.7)As | cttgtggaaaggacgaaacaccGTAATTTCTACTCTTGTAGATaca gaggaggacaaggctac | 55 |
| 18 | 5'MS2(1.7)As | cttgtggaaaggacgaaacaccGGCCAACATGAGGATCACCCA TGTCTGCAGGGCCAGTAATTTCTACTCTTGTAGATaca gaggaggacaaggctac | 56 |
| 19 | IntMS2(1.7)As | cttgtggaaaggacgaaacaccGTAATTTCTACTGGCCAACATGA GGATCACCCATGTCTGCAGGGCCAGCTTGTAGATacag aggaggacaaggctac | 57 |
| 20 | 3'MS2(1.7)As | cttgtggaaaggacgaaacaccGTAATTTCTACTCTTGTAGATaca gaggaggacaaggctacGGCCAACATGAGGATCACCCATGTC TGCAGGGCCAG | 58 |
| 21 | No MS2(1.3)Lb | cttgtggaaaggacgaaacaccGTAATTTCTACTAAGTGTAGATg ccagggaccgtttcagaca | 59 |
| 22 | 5'MS2(1.3)Lb | cttgtggaaaggacgaaacaccGGCCAACATGAGGATCACCCA TGTCTGCAGGGCCAGTAATTTCTACTAAGTGTAGATg ccagggaccgtttcagaca | 60 |
| 23 | IntMS2(1.3)Lb | cttgtggaaaggacgaaacaccGTAATTTCTACTGGCCAACATGA GGATCACCCATGTCTGCAGGGCCAGAAGTGTAGATgc cagggaccgtttcagaca | 61 |
| 24 | 3'MS2(1.3)Lb | cttgtggaaaggacgaaacaccGTAATTTCTACTAAGTGTAGATg ccagggaccgtttcagacaGGCCAACATGAGGATCACCCATGT CTGCAGGGCCAG | 62 |
| 25 | No MS2(1.4)Lb | cttgtggaaaggacgaaacaccGTAATTTCTACTAAGTGTAGATc cttgtcaaggctattggtc | 63 |
| 26 | 5'MS2(1.4)Lb | cttgtggaaaggacgaaacaccGGCCAACATGAGGATCACCCA TGTCTGCAGGGCCAGTAATTTCTACTAAGTGTAGATc cttgtcaaggctattggtc | 64 |
| 27 | IntMS2(1.4)Lb | cttgtggaaaggacgaaacaccGTAATTTCTACTGGCCAACATGA GGATCACCCATGTCTGCAGGGCCAGAAGTGTAGATcc ttgtcaaggctattggtc | 65 |
| 28 | 3'MS2(1.4)Lb | cttgtggaaaggacgaaacaccGTAATTTCTACTAAGTGTAGATc cttgtcaaggctattggtcGGCCAACATGAGGATCACCCATGTC TGCAGGGCCAG | 66 |
| 29 | No MS2(1.5)Lb | cttgtggaaaggacgaaacaccGTAATTTCTACTAAGTGTAGATt cttcatccctagccagcc | 67 |

TABLE-continued

Guide RNAs generated

| No. | Description | Sequence | SEQ ID No. |
|---|---|---|---|
| 30 | 5'MS2(1.5)Lb | cttgtggaaaggacgaaacaccGGGCCAACATGAGGATCACCCA TGTCTGCAGGGCCAGTAATTTCTACTAAGTGTAGATtt cttcatccctagccagcc | 118 |
| 31 | IntMS2(1.5)Lb | cttgtggaaaggacgaaacaccGTAATTTCTACTGGCCAACATGA GGATCACCCATGTCTGCAGGGCCAGAAGTGTAGATttc ttcatccctagccagcc | 194 |
| 32 | 3'MS2(1.5)Lb | cttgtggaaaggacgaaacaccGTAATTTCTACTAAGTGTAGATtt cttcatccctagccagccGGCCAACATGAGGATCACCCATGTC TGCAGGGCCAG | 246 |
| 33 | No MS2(1.6)Lb | cttgtggaaaggacgaaacaccGTAATTTCTACTAAGTGTAGATat tcttcatccctagccagc | 247 |
| 34 | 5'MS2(1.6)Lb | cttgtggaaaggacgaaacaccGGGCCAACATGAGGATCACCCA TGTCTGCAGGGCCAGTAATTTCTACTAAGTGTAGATat tcttcatccctagccagc | 248 |
| 35 | IntMS2(1.6)Lb | cttgtggaaaggacgaaacaccGTAATTTCTACTGGCCAACATGA GGATCACCCATGTCTGCAGGGCCAGAAGTGTAGATatt cttcatccctagccagc | 249 |
| 36 | 3'MS2(1.6)Lb | cttgtggaaaggacgaaacaccGTAATTTCTACTAAGTGTAGATat tcttcatccctagccagcGGCCAACATGAGGATCACCCATGTCT GCAGGGCCAG | 250 |
| 37 | No MS2(1.7)Lb | cttgtggaaaggacgaaacaccGTAATTTCTACTAAGTGTAGATa cagaggaggacaaggctac | 252 |
| 38 | 5'MS2(1.7)Lb | cttgtggaaaggacgaaacaccGGGCCAACATGAGGATCACCCA TGTCTGCAGGGCCAGTAATTTCTACTAAGTGTAGATa cagaggaggacaaggctac | 253 |
| 39 | IntMS2(1.7)Lb | cttgtggaaaggacgaaacaccGTAATTTCTACTGGCCAACATGA GGATCACCCATGTCTGCAGGGCCAGAAGTGTAGATac agaggaggacaaggctac | 254 |
| 40 | 3'MS2(1.7)Lb | cttgtggaaaggacgaaacaccGTAATTTCTACTAAGTGTAGATa cagaggaggacaaggctacGGCCAACATGAGGATCACCCATGT CTGCAGGGCCAG | 255 |

With regard to the mutant Cpf1 enzyme, different mutant proteins were generated, i.e. AsCpf1 mutant proteins (AsD908A, AsE993A, AsD1263A) and LbCpf1 mutant proteins (LbD832A), E925A, D947A and D1180A. All of these were found not to cleave DNA in vitro.

In the experiments several of these mutants were tested with 5 guide RNA sequences (containing the corresponding PAM sequence) with the MS2 inserted in 4 different positions i.e. no MS2, 5' MS2, internal MS2, and 3' MS2). As a positive control, we transfected cells with dCas9 and a SAM-Hbg1 guide (guide sequence: GGGCAAGGCTGGC-CAACCCAT (SEQ ID No 292)).

In order to determine whether the system could ensure activation of the Hbg1 gene, the mutated Cpf1 enzyme and guide sequences were introduced into a cell. More specifically, HEK293 cells were transfected with 500 ng total DNA i.e. 300 ng Cpf1 clone 908 AsCpf1 mutant or clone 300 LbCpf1 mutant plasmid, as well as 100 ng MPH (MS2-p65-HSF1, p65 and HSF1 being transactivation domains), and 100 ng guide in 24 well plates. The guide was used as a PCR product, everything else was plasmid. 48 hours later, cells were isolated with Cells to Ct kit and qPCR was performed. The table below shows the ratio HBG1/GapDH mRNA normalized to GFP treated cells.

It is demonstrated that there is modest activation of the HBG1 gene.

TABLE

HBG1/GapDH mRNA normalized to GFP treated cells

| Spacer sequence | Condition | HBG1/GapDH mRNA (Normalized to GFPtreated cells) | |
|---|---|---|---|
| | | AsCpf1 mutant | LbCpf1 mutant |
| | Nothing | 0.7 | |
| | | 0.9 | 1.6 |
| | | 1.1 | 2.1 |
| | GFP | 0.8 | 0.8 |
| | | 1.2 | 0.7 |
| | | 0.9 | 1.6 |
| | MPH only | 1.4 | 5.4 |
| | | 1.4 | 2.5 |
| | | 1.1 | 1.5 |
| | Cpf1 only | 2.7 | 0.9 |
| | | 0.6 | 1.1 |
| | | 0.6 | 1.4 |
| | Cr 1 Only | 25.9 | 1.3 |
| | | 0.6 | 0.9 |
| | | 1.6 | 2.8 |

TABLE-continued

HBG1/GapDH mRNA normalized to GFP treated cells

| Spacer sequence | Condition | AsCpf1 mutant | LbCpf1 mutant |
|---|---|---|---|
| | Cr 2 Only | 0.6 | 1.0 |
| | | 1.0 | 0.7 |
| | | 0.7 | 1.1 |
| | dCas9 | 7622.0 | 4223.6 |
| | | 5436.5 | 4487.7 |
| | | 5502.8 | 4985.1 |
| | dCas9 VP64 | 4976.6 | 3576.3 |
| | | 6244.9 | 2738.7 |
| | | 6201.7 | 3348.4 |
| 5 Guide Combinations | No MS2 | 2.2 | 1.3 |
| | | 0.9 | 2.7 |
| | | 1.2 | 1.3 |
| | 5'MS2 | 1.7 | 1.3 |
| | | 1.9 | 2.1 |
| | | 0.9 | 1.9 |
| | Internal MS2 | 1.3 | 2.0 |
| | | 1.0 | 1.6 |
| | | 0.9 | 1.7 |
| | 3'MS2 | 0.8 | 1.9 |
| | | 12.4 | 2.2 |
| | | 0.9 | 1.8 |
| Spacer Sequence 1 | No MS2 | 1.7 | 2.1 |
| | | 0.3 | 1.8 |
| | | 2.0 | 2.9 |
| | 5'MS2 | 1.5 | 1.2 |
| | | 1.0 | 1.9 |
| | | 1.2 | 1.3 |
| | Internal MS2 | 1.2 | 1.5 |
| | | 1.2 | 1.9 |
| | | 2.1 | 1.7 |
| | 3'MS2 | 2.2 | 2.0 |
| | | 3.9 | 1.9 |
| | | 1.2 | 2.0 |
| Spacer Sequence 2 | No MS2 | 1.2 | 1.9 |
| | | 0.8 | 1.6 |
| | | 1.8 | 1.5 |
| | 5'MS2 | 2.5 | 1.9 |
| | | 1.2 | 1.6 |
| | | 1.7 | 1.4 |
| | Internal MS2 | 1.2 | 1.7 |
| | | 1.2 | 2.1 |
| | | 0.8 | 2.1 |
| | 3'MS2 | 1.4 | 1.7 |
| | | 0.5 | 2.0 |
| | | 1.2 | 1.8 |
| Spacer Sequence 3 | No MS2 | 2.1 | 2.3 |
| | | 1.1 | 2.1 |
| | | 1.4 | 3.8 |
| | 5'MS2 | 1.3 | 2.0 |
| | | 0.9 | 2.1 |
| | | 1.1 | 3.0 |
| | Internal MS2 | 1.3 | 3.5 |
| | | 0.8 | 2.4 |
| | | 0.8 | 2.0 |
| | 3'MS2 | 1.8 | 1.9 |
| | | 1.4 | 2.1 |
| | | 2.8 | 1.6 |
| Spacer Sequence 4 | No MS2 | 1.8 | 1.6 |
| | | 1.0 | 2.0 |
| | | 1.9 | 1.8 |
| | 5'MS2 | 0.8 | 0.9 |
| | | 1.4 | 1.6 |
| | | 2.6 | 2.3 |
| | Internal MS2 | 2.0 | 2.2 |
| | | 0.9 | 2.2 |
| | | 0.7 | 1.7 |
| | 3'MS2 | 1.2 | 2.0 |
| | | 1.4 | 1.9 |
| | | 1.9 | 1.3 |
| Spacer Sequence 5 | No MS2 | 1.3 | 1.3 |
| | | 0.9 | 1.2 |
| | | 1.5 | 0.3 |
| | 5'MS2 | 0.8 | 1.0 |
| | | 1.2 | 1.4 |
| | | 1.2 | 2.2 |
| | Internal MS2 | 1.2 | 1.3 |
| | | 0.9 | 2.1 |
| | | 1.9 | 1.5 |
| | 3'MS2 | 1.2 | 1.9 |
| | | 1.1 | 2.3 |
| | | 1.1 | 1.6 |

In a further experiment, HEK.293 cells were transfected with 100 ng Cpf1 plasmid, 100 ng guide as PCR product, and 100 ng MS2-p65-HSF 1 plasmid. 48 hours later, cells were harvested and HBG1 mRNA (relative to control gene GapDH) was quantified using Cells-to-ct. The type of Cpf1 as well as the number of NLS on the protein were varied as follows.

| Protein | Guide | Normalized HBG1/GapDH mRNA |
|---|---|---|
| AsD908A VP64 2XNLS | Well A1 Guide (No MS2) | 1.40 |
| | | 2.10 |
| | | 0.98 |
| AsD908A VP64 2XNLS | Well A5 Guide (No MS2) | 1.09 |
| | | 1.05 |
| | | 1.96 |
| AsD908A VP64 2XNLS | Well A9 Guide (No MS2) | 4.75 |
| | | 1.42 |
| | | 2.71 |
| AsD908A VP64 2XNLS | Well B1 Guide (No MS2) | 3.34 |
| | | 2.55 |
| | | 4.93 |
| AsD908A VP64 2XNLS | Well A3 Guide (Yes MS2) | 1.78 |
| | | 3.58 |
| | | 2.14 |
| AsD908A VP64 2XNLS | Well A7 Guide (Yes MS2) | 2.82 |
| | | 1.70 |
| | | 3.41 |
| AsD908A VP64 2XNLS | Well A11 Guide (Yes MS2) | 2.51 |
| | | 1.06 |
| | | 2.28 |
| AsD908A VP64 2XNLS | Well B3 Guide (Yes MS2) | 3.80 |
| | | 3.28 |
| | | 4.59 |
| As E993A VP64 1X NLS | Well A1 Guide (No MS2) | 2.10 |
| | | 0.81 |
| | | 1.97 |
| As E993A VP64 1X NLS | Well A5 Guide (No MS2) | 0.93 |
| | | 1.11 |
| | | 1.49 |
| As E993A VP64 1X NLS | Well A9 Guide (No MS2) | 0.87 |
| | | 1.23 |
| | | 0.50 |
| As E993A VP64 1X NLS | Well B1 Guide (No MS2) | 0.79 |
| | | 0.95 |
| | | 2.24 |
| As E993A VP64 1X NLS | Well A3 Guide (Yes MS2) | 1.48 |
| | | 1.48 |
| | | 2.50 |
| As E993A VP64 1X NLS | Well A7 Guide (Yes MS2) | 1.01 |
| | | 1.49 |
| | | 2.07 |
| As E993A VP64 1X NLS | Well A11 Guide (Yes MS2) | 1.20 |
| | | 2.69 |
| | | 1.63 |

-continued

| Protein | Guide | Normalized HBG1/GapDH mRNA |
|---|---|---|
| As E993A VP64 1X NLS | Well B3 Guide (Yes MS2) | 1.54 |
| | | 2.90 |
| | | 3.73 |
| As D1263A VP64 1X NLS | Well A1 Guide (No MS2) | 1.37 |
| | | 1.14 |
| | | 0.76 |
| As D1263A VP64 1X NLS | Well A5 Guide (No MS2) | 1.78 |
| | | 2.37 |
| | | 1.21 |
| As D1263A VP64 1X NLS | Well A9 Guide (No MS2) | 0.40 |
| | | 2.23 |
| | | 1.61 |
| As D1263A VP64 1X NLS | Well B1 Guide (No MS2) | 0.89 |
| | | 1.87 |
| | | 1.51 |
| As D1263A VP64 1X NLS | Well A3 Guide (Yes MS2) | 0.89 |
| | | 1.60 |
| | | 1.98 |
| As D1263A VP64 1X NLS | Well A7 Guide (Yes MS2) | 1.10 |
| | | 0.79 |
| | | 1.41 |
| As D1263A VP64 1X NLS | Well A11 Guide (Yes MS2) | 1.26 |
| | | 0.86 |
| | | 1.23 |
| As D1263A VP64 1X NLS | Well B3 Guide (Yes MS2) | 0.93 |
| | | 0.84 |
| | | 1.76 |
| GFP | GFP | 1.42 |
| | | 0.55 |
| | | 0.74 |
| AsD908A VP64 2XNLS | GFP | 0.81 |
| | | 1.16 |
| | | 1.54 |
| LbD832A VP64 1XNLS | GFP | 1.76 |
| | | 1.22 |
| | | 0.45 |
| dCas9-VP64 GFP | HBG1 Sam Activator GFP | 0.85 |
| | | 1.05 |
| | | 1.38 |
| AsD908A VP64 2XNLS | GFP | 1.30 |
| | | 1.75 |
| | | 1.48 |
| LbD832A VP64 1XNLS | GFP | 1.36 |
| | | 1.22 |
| | | 0.85 |
| dCas9-VP64 | HBG1 Sam Activator | |

In yet a further experiment, the following inactivated enzyme plasmids were used:
As D908A VP64 2×NLS
As E993A VP64 1×NLS
As D1263A VP64 1×NLS
Lb D832A 1×NLS
Lb E925A VP64 2×NLS
Lb D947A VP64 2×NLS
Lb D1118OA VP64 2×NLS The conditions were as for the previous experiments. HEK293 cells were transfected with 500 ng total DNA i.e. 300 ng Cpf1 mutant (linked to VP64 and one or more NLS) plasmid, as well as 100 ng MPH and 100 ng guide in 24 well plates. The guides contained either no or an internal MS loop and were used as a PCR product, everything else was plasmid. 48 hours later, cells were isolated with Cells to Ct kit and qPCR was performed. The table below shows the ratio HBG1/GapDH mRNA normalized to GFP treated cells.

| Normalized to GFP | Well on Master Plate | Protein | Guide |
|---|---|---|---|
| 1.57 | A1 | As D908A VP64 2XNLS | Plate Well A1-No MS2 |
| 1.36 | A2 | | |
| 0.27 | A3 | | |
| 1.27 | A4 | As D908A VP64 2XNLS | Plate Well A5-No MS2 |
| 1.87 | A5 | | |
| 0.91 | A6 | | |
| 1.69 | A7 | As D908A VP64 2XNLS | Plate Well A9-No MS2 |
| 1.21 | A8 | | |
| 2.18 | A9 | | |
| 2.39 | A10 | As D908A VP64 2XNLS | Plate Well B1-No MS2 |
| 3.63 | A11 | | |
| 3.31 | A12 | | |
| 1.44 | b1 | As D908A VP64 2XNLS | Plate Well A3-Internal MS2 |
| 3.06 | b2 | | |
| 1.62 | b3 | | |
| 2.09 | b4 | As D908A VP64 2XNLS | Plate Well A7-Internal MS2 |
| 1.54 | b5 | | |
| 2.88 | b6 | | |
| 1.19 | b7 | As D908A VP64 2XNLS | Plate Well A11-Internal MS2 |
| 0.80 | b8 | | |
| 2.10 | b9 | | |
| 3.20 | b10 | As D908A VP64 2XNLS | Plate Well B3-Internal MS2 |
| 2.45 | b11 | | |
| 3.50 | b12 | | |
| 2.19 | C1 | As E993A VP64 1XNLS | Plate Well A1-No MS2 |
| 1.43 | C2 | | |
| 2.31 | C3 | | |
| 1.11 | C4 | As E993A VP64 1XNLS | As E993A VP64 1XNLS |
| 1.08 | C5 | | |
| 1.94 | C6 | | |
| 0.95 | C7 | As E993A VP64 1XNLS | Plate Well A9-No MS2 |
| 1.05 | C8 | | |
| 0.84 | C9 | | |

-continued

| Normalized to GFP | Well on Master Plate | Protein | Guide |
|---|---|---|---|
| 1.14 | C10 | As E993A VP64 1XNLS | Plate Well B1-No MS2 |
| 2.13 | C11 | | |
| 1.55 | C12 | | |
| 1.36 | D1 | As E993A VP64 1XNLS | Plate Well A3-Internal MS2 |
| 1.37 | D2 | | |
| 2.55 | D3 | | |
| 1.59 | D4 | As E993A VP64 1XNLS | Plate Well A7-Internal MS2 |
| 1.52 | D5 | | |
| 1.77 | D6 | | |
| 0.60 | D7 | As E993A VP64 1XNLS | Plate Well A11-Internal MS2 |
| 2.67 | D8 | | |
| 1.40 | D9 | | |
| 1.55 | D10 | As E993A VP64 1XNLS | Plate Well B3-Internal MS2 |
| 2.13 | D11 | | |
| 3.14 | D12 | | |
| 1.70 | E1 | As D1263A VP64 1XNLS | Plate Well A1-No MS2 |
| 1.26 | E2 | | |
| 1.24 | E3 | | |
| 2.88 | E4 | As D1263A VP64 1XNLS | Plate Well A5-No MS2 |
| 2.38 | E5 | | |
| 1.44 | E6 | | |
| 0.98 | E7 | As D1263A VP64 1XNLS | Plate Well A9-No MS2 |
| 2.95 | E8 | | |
| 1.55 | E9 | | |
| 1.20 | E10 | As D1263A VP64 1XNLS | Plate Well B1-No MS2 |
| 1.39 | E11 | | |
| 2.41 | E12 | | |
| 1.68 | F1 | As D1263A VP64 1XNLS | Plate Well A3-Internal MS2 |
| 1.80 | F2 | | |
| 2.16 | F3 | | |
| 2.24 | F4 | As D1263A VP64 1XNLS | Plate Well A7-Internal MS2 |
| 1.28 | F5 | | |
| 1.35 | F6 | | |
| 1.41 | F7 | As D1263A VP64 1XNLS | Plate Well A11-Internal MS2 |
| 1.51 | F8 | | |
| 1.52 | F9 | | |
| 1.36 | F10 | As D1263A VP64 1XNLS | Plate Well B3-Internal MS2 |
| 1.20 | F11 | | |
| 1.17 | F12 | | |
| 1.80 | G1 | GFP | GFP |
| 0.65 | G2 | | |
| 0.54 | G3 | | |
| 0.51 | G4 | As D908A VP64 2X NLS Only | GFP |
| 0.96 | G5 | | |
| 1.79 | G6 | | |
| 2.39 | G7 | Lb D832A 1X NLS Only | GFP |
| 0.82 | G8 | | |
| 0.50 | G9 | | |
| | G10 | dCas9 VP64 | SAM Activator (dRNA paper FIG. 1, but 20 bp sequence) |
| | G11 | | |
| | G12 | | |
| 0.96 | H1 | GFP | GFP |
| 0.89 | H2 | | |
| 1.16 | H3 | | |
| 0.98 | H4 | As D908A VP64 2X NLS Only | GFP |
| 1.78 | H5 | | |
| 1.38 | H6 | | |
| 1.10 | H7 | Lb D832A 1X NLS Only | GFP |
| 1.14 | H8 | | |
| 0.97 | H9 | | |
| | H10 | dCas9 VP64 | SAM Activator (dRNA paper FIG. 1, but 20 bp sequence) |
| | H11 | | |
| | H12 | | |
| 1.63 | A1 | Lb D832A VP64 1XNLS | Guide Plate Well C1-No MS2 |
| 0.97 | A2 | | |
| 0.75 | A3 | | |
| 0.93 | A4 | Lb D832A VP64 1XNLS | Guide Plate Well C5-No MS2 |
| 0.84 | A5 | | |
| 1.66 | A6 | | |
| 1.77 | A7 | Lb D832A VP64 1XNLS | Guide Plate Well C9-No MS2 |
| 1.90 | A8 | | |
| 1.44 | A9 | | |
| 1.92 | A10 | Lb D832A VP64 1XNLS | Guide Plate Well D1-No MS2 |
| 1.72 | A11 | | |
| 2.41 | A12 | | |

-continued

| Normalized to GFP | Well on Master Plate | Protein | Guide |
|---|---|---|---|
| 2.20 | b1 | Lb D832A VP64 1XNLS | Guide Plate Well C3-Internal MS2 |
| 1.28 | b2 | | |
| 2.13 | b3 | | |
| 1.52 | b4 | Lb D832A VP64 1XNLS | Guide Plate Well C7-Internal MS2 |
| 0.92 | b5 | | |
| 2.07 | b6 | | |
| 2.25 | b7 | Lb D832A VP64 1XNLS | Guide Plate Well C11-Internal MS2 |
| 3.05 | b8 | | |
| 7.00 | b9 | | |
| 2.57 | b10 | Lb D832A VP64 1XNLS | Guide Plate Well D3-Internal MS2 |
| 4.30 | b11 | | |
| 4.83 | b12 | | |
| 1.40 | C1 | Lb E925A VP64 2XNLS | Guide Plate Well C1-No MS2 |
| 0.89 | C2 | | |
| 1.64 | C3 | | |
| 0.97 | C4 | Lb E925A VP64 2XNLS | Guide Plate Well C5-No MS2 |
| 0.79 | C5 | | |
| 2.37 | C6 | | |
| 2.01 | C7 | Lb E925A VP64 2XNLS | Guide Plate Well C9-No MS2 |
| 0.81 | C8 | | |
| 1.82 | C9 | | |
| 2.34 | C10 | Lb E925A VP64 2XNLS | Guide Plate Well D1-No MS2 |
| 2.41 | C11 | | |
| 1.86 | C12 | | |
| 0.61 | D1 | Lb E925A VP64 2XNLS | Guide Plate Well C3-Internal MS2 |
| 1.29 | D2 | | |
| 2.08 | D3 | | |
| 3.28 | D4 | Lb E925A VP64 2XNLS | Guide Plate Well C7-Internal MS2 |
| 1.62 | D5 | | |
| 1.48 | D6 | | |
| 4.74 | D7 | Lb E925A VP64 2XNLS | Guide Plate Well C11-Internal MS2 |
| 2.29 | D8 | | |
| 3.47 | D9 | | |
| 4.86 | D10 | Lb E925A VP64 2XNLS | Guide Plate Well D3-Internal MS2 |
| 6.44 | D11 | | |
| 5.63 | D12 | | |
| 0.85 | E1 | Lb D947A VP64 2XNLS | Guide Plate Well C1-No MS2 |
| 0.85 | E2 | | |
| 0.60 | E3 | | |
| 1.10 | E4 | Lb D947A VP64 2XNLS | Guide Plate Well C5-No MS2 |
| 0.71 | E5 | | |
| 2.18 | E6 | | |
| 2.30 | E7 | Lb D947A VP64 2XNLS | Guide Plate Well C9-No MS2 |
| 1.77 | E8 | | |
| 1.94 | E9 | | |
| 2.40 | E10 | Lb D947A VP64 2XNLS | Guide Plate Well D1-No MS2 |
| 1.72 | E11 | | |
| 1.70 | E12 | | |
| 0.70 | F1 | Lb D947A VP64 2XNLS | Guide Plate Well C3-Internal MS2 |
| 0.64 | F2 | | |
| 0.49 | F3 | | |
| 1.96 | F4 | Lb D947A VP64 2XNLS | Guide Plate Well C7-Internal MS2 |
| 0.54 | F5 | | |
| 4.49 | F6 | | |
| 1.28 | F7 | Lb D947A VP64 2XNLS | Guide Plate Well C11-Internal MS2 |
| 1.51 | F8 | | |
| 2.22 | F9 | | |
| 3.50 | F10 | Lb D947A VP64 2XNLS | Guide Plate Well D3-Internal MS2 |
| 6.19 | F11 | | |
| 4.47 | F12 | | |
| 1.11 | G1 | Lb D1180A VP64 2XNLS | Guide Plate Well C1-No MS2 |
| 0.69 | G2 | | |
| 1.10 | G3 | | |
| 0.95 | G4 | Lb D1180A VP64 2XNLS | Guide Plate Well C5-No MS2 |
| 0.34 | G5 | | |
| 0.99 | G6 | | |
| 0.93 | G7 | Lb D1180A VP64 2XNLS | Guide Plate Well C9-No MS2 |
| 1.69 | G8 | | |
| 2.08 | G9 | | |
| 1.45 | G10 | Lb D1180A VP64 2XNLS | Guide Plate Well D1-No MS2 |
| 2.42 | G11 | | |
| 3.49 | G12 | | |
| 1.53 | H1 | Lb D1180A VP64 2XNLS | Guide Plate Well C3-Internal MS2 |
| 2.55 | H2 | | |
| 2.51 | H3 | | |

-continued

| Normalized to GFP | Well on Master Plate | Protein | Guide |
|---|---|---|---|
| 2.01 | H4 | Lb D1180A VP64 2XNLS | Guide Plate Well C7-Internal MS2 |
| 2.23 | H5 | | |
| 2.56 | H6 | | |
| 1.70 | H7 | Lb D1180A VP64 2XNLS | Guide Plate Well C11-Internal MS2 |
| 2.07 | H8 | | |
| 1.33 | H9 | | |
| 2.84 | H10 | Lb D1180A VP64 2XNLS | Guide Plate Well D3-Internal MS2 |
| 2.09 | H11 | | |
| 3.47 | H12 | | |
| 1.63 | A1 | As D908A VP64 2XNLS | All Four Guides in Combo-No MS2 |
| 1.20 | A2 | | |
| 1.96 | A3 | | |
| 2.78 | A7 | Lb D832A VP64 1X NLS | All Four Guides in Combo-No MS2 |
| 1.99 | A8 | | |
| 1.45 | A9 | | |
| 0.83 | b1 | As D908A VP64 2XNLS | All Four Guides in Combo-No MS2 |
| 1.47 | b2 | | |
| 0.95 | b3 | | |
| 4.87 | b7 | Lb D832A VP64 1X NLS | All Four Guides in Combo-with MS2 |
| 3.44 | b8 | | |
| 4.41 | b9 | | |
| 2.16 | C1 | As E993A VP64 | All Four Guides in Combo-No MS2 |
| 0.63 | C2 | | |
| 1.17 | C3 | | |
| 1.65 | D1 | As E993A VP64 | All Four Guides in Combo-with MS2 |
| 0.78 | D2 | | |
| 0.56 | D3 | | |
| 2.52 | D7 | LpCpf1 E925A VP64 2X NLS | All Four Guides in Combo-with MS2 |
| 1.85 | D8 | | |
| 2.01 | D9 | | |
| 0.66 | E1 | As D1263A VP64 | All Four Guides in Combo-No MS2 |
| 1.16 | E2 | | |
| 1.32 | E3 | | |
| 1.80 | E7 | LbCpf1 D947A VP64 2X NLS | All Four Guides in Combo-No MS2 |
| 1.00 | E8 | | |
| 1.05 | E9 | | |
| 1.39 | F1 | As D1263A VP64 | All Four Guides in Combo-with MS2 |
| 0.63 | F2 | | |
| 0.48 | F3 | | |
| 0.99 | F7 | LbCpf1 D947A VP64 2X NLS | All Four Guides in Combo-with MS2 |
| 1.14 | F8 | | |
| 1.76 | F9 | | |
| 1.55 | G1 | GFP Only | GFP Only |
| 0.29 | G2 | | |
| 0.45 | G3 | | |
| 2.69 | G7 | LbCpf1 D1180A VP64 2X NLS | All Four Guides in Combo-No MS2 |
| 1.63 | G8 | | |
| 1.63 | G9 | | |
| 608.61 | G10 | dCas9 VP64 | SAM Pos Control (dRNA paper, FIG. 1 20 bp) |
| 1225.68 | G11 | | |
| 2577.69 | G12 | | |
| 1.10 | H1 | GFP Only | GFP Only |
| 0.59 | H2 | | |
| 1.16 | H3 | | |
| 2.62 | H7 | LbCpf1 D1180A VP64 2X NLS | All Four Guides in Combo-with MS2 |
| 2.32 | H8 | | |
| 3.26 | H9 | | |
| 1198.38 | H10 | dCas9 VP64 | SAM Pos Control (dRNA paper, FIG. 1 20 bp) |

In yet a further experiment, the following inactivated enzyme plasmids were used:

| Plasmids |
|---|
| huAsCpf1(D908A)-NLS-VP64 |
| huAsCpf1(E993A)-NLS-VP64 |
| huAsCpf1(D1263A)-NLS-VP64 |
| huLbCpf1(D832A)-NLS-VP64 |
| huLbCpf1(D925A)-NLS-VP64 |
| huLbCpf1(E947A)-NLS-VP64 |
| huLbCpf1(D1180A)-NLS-VP64 |
| *NLS-huLbCpf1(D832A)-NLS-VP64 |

-continued

| Plasmids |
|---|
| *NLS-huLbCpf1(D925A)-NLS-VP64 |
| *NLS-huLbCpf1(E947A)-NLS-VP64 |
| *NLS-huLbCpf1(D1180A)-NLS-VP64 |

*Containing two NLS sequences (N- and C-terminal) as previously annotated.

Each plasmid was co-transfected with two (MYOD1) or three (ASCL1) guide-expression plasmids. Guides were designed to target the promoter region of each gene, and are listed in the Table below.

| | | SEQ ID NO: |
|---|---|---|
| MYOD1 guide sequences | | |
| Guide 1 | 5'-gaaagggcgtgccggagagccaa-3' | 256 |
| Guide 2 | 5'-caaacctctccaacacccgactg-3' | 257 |
| Guide 3 | 5'-tccgtagtagcctaaacgccccg-3' | 258 |
| Guide 4 | 5'-ggctactacggataaatagccca-3' | 259 |
| ASCL1 guide sequences | | |
| Guide 1 | 5'-ttcagccgggagtccggcacgcg-3' | 260 |
| Guide 2 | 5'-ttgttgcagtgcgtgcgcctggc-3' | 261 |
| Guide 3 | 5'-caaggagcgggagaaaggaacgg-3' | 262 |
| Guide 4 | 5'-tcccgctccttgcaaactctcca-3' | 263 |
| Guide 5 | 5'-gggagtgggtgggaggaagaggt-3' | 264 |
| Guide 6 | 5'-aatgggacacccagccccacgcg-3' | 265 |

HEK293T cells were maintained in DMEM+GLUTA-MAX™ (GIBCO®) supplemented with 10% Fetal Bovine Serum (HyClone) at 37° C. and 5% CO2. Thirty thousand cells per well were plated in poly-D-lysine coated 96-well plates (Corning) 24h before transfection. Cells were co-transfected with 100 ng protein-expression plasmid and 80 ng guide-expression plasmid using Lipofectamine 2000 (Life Technologies). RNA was harvested 48h post-transfection according to the Cell to Ct protocol. Results from qPCR readout of ASCL1 transcripts or MYOD1 transcripts are provided in FIG. 81 A and FIG. 81 B; C respectively.

Example 20: In Vivo Delivery of Cpf1

Design of Cpf1 Constructs for AAV Delivery

Codon optimized Cpf1 genes from Lachnospiraceae and *Acidaminococcus* (Zetsche et al. 2015) were PCR amplified and an N-terminal nuclear localization signal and HA-tag was attached. A short polyA signal was attached to the C-terminus. The PCR amplicons were cloned into an AAV vector (Swiech et al, 2015) using AgeI/NotI restriction sites resulting in the final vectors as shown in FIG. 82A. Viral vectors encoding for three guide RNAs under control of U6 promoter were cloned as followed: Gene blocks encoding for U6 promoter and three Cpf1 guide RNAs in tandem were cloned into an AAV vector encoding for human Synapsin-GFP-KASH using NheI/MluI restriction sites resulting in the final vectors as shown in FIG. 82B. A vector for SapI cloning of annealed oligos was synthesized using NheI/MluI restriction sites resulting into the final vector as shown in FIG. 82C. All final vectors were sequence verified.

PCR Primer:

AsCpf1 NLS-HA-fw
(SEQ ID NO: 266)
aacacaggaccggtGccAccatgtacccatacgatgttccagattacgct tcgccgaagaaaaagcgcaaggtcgaagcgtccACACAGTTCGAGGGCTT

TACCAACCTGTATCAGGTGAGC

AsCpf1-spA-rv
(SEQ ID NO: 267)
gcggccgcACACAAAAAACCAACACACAGATCTAATGAAAATAAAGATCT TTTATTgaattcttaGTTGCGCAGCTCCTGGATGTAGGCCAGCC LbCpf1 NLS-HA-fw
(SEQ ID NO: 268)
TACCGGATCCCCGGGTACCGGTATGTACCCATACGATGTTCCAGATTACG

CTTCGCCGAAGAAAAGCGCAAGGTCGAAGCGTCCAGCAAGCTGGAGAAG

TTTACAAACTGCTACTCC

LbCpf1-spA-rv
(SEQ ID NO: 269)
GCGGCCGCACACAAAAAACCAACACACAGATCTAATGAAAATAAAGATCT

TTTATTGAATTCTTAGTGCTTCACGCTGGTCTGGGCGTACTCCAGCCACT

CCTTGTTAGAGATGG

Gene Blocks (*Macaca mulatta*):

Cpf1 rhesus (vector 1): Mecp2/Nlgn3/Drd1
(SEQ ID NO: 270)
Cctacgctagcctgagggcctatttcccatgattccttcatatttgcata tacgatacaaggctgttagagagataattggaattaatttgactgtaaac acaaagatattagtacaaaatacgtgacgtagaaagtaataatttcttgg gtagtttgcagttttaaaattatgttttaaaatggactatcatatgctta ccgtaacttgaaagtatttcgatttcttggctttatatatcttgtggaaa ggacgaaacaccgTAATTTCTACTCTTGTAGATCCTGCCTCTGCGGGCTC

AGCTAATTTCTACTCTTGTAGATCGGCGGGTCTCAGGGTTGTCTAATTTC

TACTCTTGTAGATCTGTCGCTGCTCATCCTGTCTTTTTTcgACGCGT

Cpf1 rhesus (vector 2): Mecp2/Nlgn3/Drd1
(SEQ ID NO: 271)
Cctacgctagcctgagggcctatttcccatgattccttcatatttgcata tacgatacaaggctgttagagagataattggaattaatttgactgtaaac acaaagatattagtacaaaatacgtgacgtagaaagtaataatttcttgg gtagtttgcagttttaaaattatgttttaaaatggactatcatatgctta ccgtaacttgaaagtatttcgatttcttggctttatatatcttgtggaaa ggacgaaacaccgTAATTTCTACTCTTGTAGATTTCACCTTTTTAAACTT

GAGTAATTTCTACTCTTGTAGATGGGTTCCTATGGTAGGCCCCTAATTTC

TACTCTTGTAGATTCATCTCCTTGGCCGTGTCATTTTTTcgACGCGT

Gene Blocks (*Mus musculus*):

Cpf1 mouse (vector 1) Mecp2/Nlgn3/Drd1
(SEQ ID NO: 272)
Cctacgctagcctgagggcctatttcccatgattccttcatatttgcata tacgatacaaggctgttagagagataattggaattaatttgactgtaaac acaaagatattagtacaaaatacgtgacgtagaaagtaataatttcttgg gtagtttgcagttttaaaattatgttttaaaatggactatcatatgctta ccgtaacttgaaagtatttcgatttcttggctttatatatcttgtggaaa -continued
ggacgaaacaccgTAATTTCTACTCTTGTAGATCCTGCCTCTGCTGGCTC

TGCTAATTTCTACTCTTGTAGATCGGCGGGTCTCAGGGTTGTCTAATTTC

TACTCTTGTAGATTGTCCCTGCTTATCCTGTCCTTTTTTcgACGCGT

Cpf1 mouse (vector 2) Mecp2/Nlgn3/Drd1

(SEQ ID NO: 273)
Cctacgctagcctgagggcctatttcccatgattccttcatatttgcata tacgatacaaggctgttagagagataattggaattaatttgactgtaaac acaaagatattagtacaaaatacgtgacgtagaaagtaataatttcttgg gtagtttgcagttttaaaattatgttttaaaatggactatcatatgctta ccgtaacttgaaagtatttcgatttcttggctttatatatcttgtggaaa ggacgaaacaccgTAATTTCTACTCTTGTAGATTTCGCCTTCTTAAACTT

CAGTAATTTCTACTCTTGTAGATGTGTCCCTATGGTAGGTCCCTAATTTC

TACTCTTGTAGATTCATCTCTTTAGCTGTGTCATTTTTTcgACGCGT

Gene Block (SapI Cloning Site)

(SEQ ID NO: 274)
Ccctacgctagcctgagggcctatttcccatgattccttcatatttgcat atacgatacaaggctgttagagagataattggaattaatttgactgtaaa cacaaagatattagtacaaaatacgtgacgtagaaagtaataatttcttg ggtagtttgcagttttaaaattatgttttaaaatggactatcatatgctt accgtaacttgaaagtatttcgatttcttggctttatatatcttgtggaa aggacgaaacaccgTAATTTCTACTCTTGTAGATgaagagcgagctcttc

TTTTTTcgACGCGTgt
(Bold indicates SapI cloning site)

Validation of Cpf1 Expression in Primary Cortical Neurons

For AAV transduction, mouse cortical neurons in 500 μl Neurobasal culture medium were incubated at 7 DIV with up to 300 μl (double infection at 1:1 ratio) AAV1-containing conditioned medium from HEK293FT cells (Swiech et al, 2015). One week after transduction neurons were fixed in 4% paraformaldehyde for immunofluorescent stainings using anti-HA (Cell Signaling, mouse) (FIG. 83).

Validation of Guide RNAs In Vitro

Guide RNAs targeting monkey genes Mecp2, Nlgn3, and Drd1 were tested in HEK293FT cells (FIG. 84). All targeted sequences and PAM sequences were conserved between monkey and human. Guide RNAs targeting mouse genes Mecp2, Nlgn3, and Drd1 were tested in Neuro-2a (N2a) cells and primary cortical neurons cultured from P0.5 mice. HEK293FT and N2a cells were transfected using Lipofectamine®2000 as described previously, primary neurons were infected with AAV1 supernatant as described previously (Konermann, 2013, Swiech 2015) (FIG. 85). DNA was extracted from cells 48 hours post transfection, and 7 days post infection using Quick Extract lysis buffer. Surveyor nuclease assay has been performed as described previously according to the manufacture's protocol (IDT technologies).

Surveyor Primer:

| | (SEQ ID NO: 275) |
|---|---|
| MS_46 | ACAGTGCAGGTCAGGCACACC |
| | Mecp2 human surveyor fw |

| | (SEQ ID NO: 276) |
|---|---|
| MS_47 | TCTGAGTGTATGATGGCCTGG |
| | Mecp2 human surveyor fw |

| | (SEQ ID NO: 277) |
|---|---|
| MS_48 | GGTGGGGTCATCATACATGG |
| | Mecp2 human surveyor rv |

| | (SEQ ID NO: 278) |
|---|---|
| MS_49 | TTCCTGCTCCATGAGGGATCC |
| | Mecp2 human surveyor rv |

| | (SEQ ID NO: 279) |
|---|---|
| MS_50 | ATCAAGAGTGACCATCCACGG |
| | Drd1 human surveyor fw |

| | (SEQ ID NO: 280) |
|---|---|
| MS_51 | TGGCTGTGCAAAGTGCTGCCTGG |
| | Drd1 human surveyor fw |

| | (SEQ ID NO: 281) |
|---|---|
| MS_52 | CACATGATGTCAAAGGCCACC |
| | Drd1 human surveyor rv |

| | (SEQ ID NO: 282) |
|---|---|
| MS_53 | GTCCATGCCACACTGATCAGG |
| | Drd1 human surveyor rv |

| | (SEQ ID NO: 283) |
|---|---|
| MS_54 | ACCCTGAGGATGGTGTCTCTGG |
| | Nlgn3 human surveyor fw |

| | (SEQ ID NO: 284) |
|---|---|
| MS_55 | CTGGCACTGACTTTGACTATTCC |
| | Nlgn3 human surveyor fw |

| | (SEQ ID NO: 285) |
|---|---|
| MS_56 | ATATGATGGAAGAGGTTTAGC |
| | Nlgn3 human surveyor rv |

| | (SEQ ID NO: 286) |
|---|---|
| MS_57 | CCGATGCTAACTGAGTTCTAAGC |
| | Nlgn3 human surveyor rv |

| | (SEQ ID NO: 287) |
|---|---|
| CmHS_545 | GGTCTCATGTGTGGCACTCA |
| | Mecp 2mouse surveyor fw |

| | (SEQ ID NO: 288) |
|---|---|
| CmHS_547 | TGTCCAACCTTCAGGCAAGG |
| | Mecp 2mouse surveyor rv |

| | (SEQ ID NO: 289) |
|---|---|
| CmHS_846 | TGGCTAAGCCTGGCCAAGAACG |
| | Drd1 2mouse surveyor fw |

| | (SEQ ID NO: 290) |
|---|---|
| CmHS_859 | TCAGGATGAAGGCTGCCTTCGG |
| | Drd1 2mouse surveyor rv |

| | (SEQ ID NO: 291) |
|---|---|
| CmHS_967 | GTAACGTCCTGGACACTGTGG |
| | Nlgn3 2mouse surveyor fw |

| | (SEQ ID NO: 293) |
|---|---|
| CmHS_969 | TTGGTCCAATAGGTCATGACG |
| | Nlgn3 2mouse surveyor rv |

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define

PARTIES TO A JOINT RESEARCH AGREEMENT

The claimed invention was made by, on behalf of, and/or in connection with one or more of the following parties to a joint research agreement: the Broad Institute, Inc., Massachusetts Institute of Technology, and President and Fellows of Harvard College. The joint research agreement was in effect on and before the effective filing date of the claimed invention, and the claimed invention was made as a result of activities undertaken within the scope of the joint research agreement.

SEQUENCE LISTING (798 sequences)

SEQ ID NO: 1 - protein, 7 aa, Unknown
  source: /note="Description of Unknown: active site region of XerD sequence"
LYWTGMR

SEQ ID NO: 2 - protein, 7 aa, Simian virus 40
PKKKRKV

SEQ ID NO: 3 - protein, 16 aa, Unknown
  source: /note="Description of Unknown: Nucleoplasmin bipartite NLS sequence"
KRPAATKKAGQAKKKK

SEQ ID NO: 4 - protein, 9 aa, Unknown
  source: /note="Description of Unknown: C-myc NLS sequence"
PAAKRVKLD

SEQ ID NO: 5 - protein, 11 aa, Unknown
  source: /note="Description of Unknown: C-myc NLS sequence"
RQRRNELKRSP

SEQ ID NO: 6 - protein, 38 aa, Homo sapiens
NQSSNFGPMKGGNFGGRSSGPYGGGGQYFAKPRNQGGY

SEQ ID NO: 7 - protein, 42 aa, Unknown
  source: /note="Description of Unknown: IBB domain from importin-alpha sequence"
RMRIZFKNKGKDTAELRRRRVEVSVELRKAKKDEQILKRRNV

SEQ ID NO: 8 - protein, 8 aa, Unknown
  source: /note="Description of Unknown: Myoma T protein sequence"
VSRKRPRP

SEQ ID NO: 9 - protein, 8 aa, Unknown
  source: /note="Description of Unknown: Myoma T protein sequence"
PPKKARED

SEQ ID NO: 10 - protein, 8 aa, Homo sapiens
PQPKKKPL

SEQ ID NO: 11 - protein, 12 aa, Mus musculus
SALIKKKKKMAP

SEQ ID NO: 12 - protein, 5 aa, Influenza virus
DRLRR

SEQ ID NO: 13 - protein, 7 aa, Influenza virus
PKQKKRK

SEQ ID NO: 14 - protein, 10 aa, Hepatitis delta virus
RKLKKKIKKL

SEQ ID NO: 15 - protein, 10 aa, Mus musculus
REKKKFLKRR

SEQ ID NO: 16 - protein, 20 aa, Homo sapiens
KRKGDEVDGVDEVAKKKSKK

SEQ ID NO: 17 - protein, 17 aa, Homo sapiens
RKCLQAGMNLEARKTKK

SEQ ID NO: 18 - protein, 4 aa, Artificial Sequence
  source: /note="Description of Artificial Sequence: Synthetic peptide"
GGGS

SEQ ID NO: 19 - protein, 15 aa, Artificial Sequence
  source: /note="Description of Artificial Sequence: Synthetic peptide"
GGGGSGGGGSGGGGS

SEQ ID NO: 20 - protein, 30 aa, Artificial Sequence
  source: /note="Description of Artificial Sequence: Synthetic polypeptide"
GGGGSGGGGSGGGGSGGGGSGGGGSGGGGS

SEQ ID NO: 21 - protein, 45 aa, Artificial Sequence
  source: /note="Description of Artificial Sequence: Synthetic polypeptide"
GGGGSGGGGSGGGGSGGGGSGGGGSGGGGSGGGGSGGGGSGGGGS

SEQ ID NO: 22 - protein, 60 aa, Artificial Sequence
  source: /note="Description of Artificial Sequence: Synthetic polypeptide"
GGGGSGGGGSGGGGSGGGGSGGGGSGGGGSGGGGSGGGGSGGGGSGGGGSGGGGSGGGGS

SEQ ID NO: 23 - DNA, 20 bp, Homo sapiens
gagtccgagcagaagaagaa

SEQ ID NO: 24 - DNA, 20 bp, Homo sapiens
gagtcctagcaggagaagaa

SEQ ID NO: 25 - DNA, 20 bp, Homo sapiens
gagtctaagcagaagaagaa

SEQ ID NO: 26 - protein, 9 aa, Unknown
  source: /note="Description of Unknown: 'LAGLIDADG' family motif peptide"
LAGLIDADG

SEQ ID NO: 27 - DNA, 120 bp, Artificial Sequence
  source: /note="Description of Artificial Sequence: Synthetic polynucleotide"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28 - protein, 12 aa, Artificial Sequence
  source: /note="Description of Artificial Sequence: Synthetic peptide"
  MOD_RES (2)..(2): Aminohexanoyl
  MOD_RES (5)..(5): Aminohexanoyl
  MOD_RES (8)..(8): Aminohexanoyl
  MOD_RES (11)..(11): Aminohexanoyl
RXRRXRRXRRXR

SEQ ID NO: 29 - DNA, 20 bp, Artificial Sequence
  source: /note="Description of Artificial Sequence: Synthetic oligonucleotide"
ctgaattagctgtatcgtca

SEQ ID NO: 30 - DNA, 20 bp, Artificial Sequence
  source: /note="Description of Artificial Sequence: Synthetic oligonucleotide"
gaatataaacttgtggtagt

SEQ ID NO: 31 - DNA, 24 bp, Artificial Sequence
  source: /note="Description of Artificial Sequence: Synthetic oligonucleotide"
tttagccagggaccgtttcagaca

SEQ ID NO: 32 - DNA, 24 bp, Artificial Sequence
  source: /note="Description of Artificial Sequence: Synthetic oligonucleotide"
tttgccttgtcaaggctattggtc

SEQ ID NO: 33 - DNA, 24 bp, Artificial Sequence
  source: /note="Description of Artificial Sequence: Synthetic oligonucleotide"
tttattcttcatccctagccagcc

SEQ ID NO: 34 - DNA, 24 bp, Artificial Sequence
  source: /note="Description of Artificial Sequence: Synthetic oligonucleotide"
ttttattcttcatccctagccagc

SEQ ID NO: 35 - DNA, 24 bp, Artificial Sequence
  source: /note="Description of Artificial Sequence: Synthetic oligonucleotide"
tttcacagaggaggacaaggctac

SEQ ID NO: 36 - DNA, 63 bp, Artificial Sequence
  source: /note="Description of Artificial Sequence: Synthetic oligonucleotide"
cttgtggaaaggacgaaacaccgtaatttctactcttgtagatgccagggaccgtttcagaca

SEQ ID NO: 37 - DNA, 99 bp, Artificial Sequence
  source: /note="Description of Artificial Sequence: Synthetic oligonucleotide"
cttgtggaaaggacgaaacaccgggccaacatgaggatcacccatgtctgcagggccagtaatttctactcttgtagatgccagggaccgtttcagaca

SEQ ID NO: 38 - DNA, 99 bp, Artificial Sequence
  source: /note="Description of Artificial Sequence: Synthetic oligonucleotide"
cttgtggaaaggacgaaacaccgtaatttctactggccaacatgaggatcacccatgtctgcagggccagcttgtagatgccagggaccgtttcagaca

SEQ ID NO: 39 - DNA, 99 bp, Artificial Sequence
  source: /note="Description of Artificial Sequence: Synthetic oligonucleotide"
cttgtggaaaggacgaaacaccgtaatttctactcttgtagatgccagggaccgtttcagacaggccaacatgaggatcacccatgtctgcagggccag

SEQ ID NO: 40 - DNA, 63 bp, Artificial Sequence
  source: /note="Description of Artificial Sequence: Synthetic oligonucleotide"
cttgtggaaaggacgaaacaccgtaatttctactcttgtagatccttgtcaaggctattggtc

SEQ ID NO: 41 - DNA, 99 bp, Artificial Sequence
  source: /note="Description of Artificial Sequence: Synthetic oligonucleotide"
cttgtggaaaggacgaaacaccgggccaacatgaggatcacccatgtctgcagggccagtaatttctactcttgtagatccttgtcaaggctattggtc

SEQ ID NO: 42 - DNA, 99 bp, Artificial Sequence
  source: /note="Description of Artificial Sequence: Synthetic oligonucleotide"
cttgtggaaaggacgaaacaccgtaatttctactggccaacatgaggatcacccatgtctgcagggccagcttgtagatccttgtcaaggctattggtc

SEQ ID NO: 43 - DNA, 99 bp, Artificial Sequence
  source: /note="Description of Artificial Sequence: Synthetic oligonucleotide"
cttgtggaaaggacgaaacaccgtaatttctactcttgtagatccttgtcaaggctattggtcggccaacatgaggatcacccatgtctgcagggccag

SEQ ID NO: 44 - DNA, 63 bp, Artificial Sequence
  source: /note="Description of Artificial Sequence: Synthetic oligonucleotide"
cttgtggaaaggacgaaacaccgtaatttctactcttgtagatttcttcatccctagccagcc

SEQ ID NO: 45 - DNA, 99 bp, Artificial Sequence
  source: /note="Description of Artificial Sequence: Synthetic oligonucleotide"
cttgtggaaaggacgaaacaccgggccaacatgaggatcacccatgtctgcagggccagtaatttctactcttgtagatttcttcatccctagccagcc

SEQ ID NO: 46 - DNA, 99 bp, Artificial Sequence
  source: /note="Description of Artificial Sequence: Synthetic oligonucleotide"
cttgtggaaaggacgaaacaccgtaatttctactggccaacatgaggatcacccatgtctgcagggccagcttgtagatttcttcatccctagccagcc

SEQ ID NO: 47 - DNA, 99 bp, Artificial Sequence
  source: /note="Description of Artificial Sequence: Synthetic oligonucleotide"
cttgtggaaaggacgaaacaccgtaatttctactcttgtagatttcttcatccctagccagccggccaacatgaggatcacccatgtctgcagggccag

SEQ ID NO: 48 - DNA, 63 bp, Artificial Sequence
  source: /note="Description of Artificial Sequence: Synthetic oligonucleotide"
cttgtggaaaggacgaaacaccgtaatttctactcttgtagatattcttcatccctagccagc

SEQ ID NO: 49 - RNA, 36 nt, Artificial Sequence
  source: /note="Description of Artificial Sequence: Synthetic oligonucleotide"
gucuaagaacuuuaaauaauuucuacuguuguagau

SEQ ID NO: 50 - DNA, 99 bp, Artificial Sequence
  source: /note="Description of Artificial Sequence: Synthetic oligonucleotide"
cttgtggaaaggacgaaacaccgggccaacatgaggatcacccatgtctgcagggccagtaatttctactcttgtagatattcttcatccctagccagc

SEQ ID NO: 51 - protein, 1300 aa, Francisella ularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 52 - DNA, 138 bp, Artificial Sequence
  source: /note="Description of Artificial Sequence: Synthetic polynucleotide"
aaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 53 - DNA, 99 bp, Artificial Sequence
  source: /note="Description of Artificial Sequence: Synthetic oligonucleotide"
cttgtggaaaggacgaaacaccgtaatttctactggccaacatgaggatcacccatgtctgcagggccagcttgtagatattcttcatccctagccagc

SEQ ID NO: 54 - DNA, 99 bp, Artificial Sequence
  source: /note="Description of Artificial Sequence: Synthetic oligonucleotide"
cttgtggaaaggacgaaacaccgtaatttctactcttgtagatattcttcatccctagccagcggccaacatgaggatcacccatgtctgcagggccag

SEQ ID NO: 55 - DNA, 63 bp, Artificial Sequence
  source: /note="Description of Artificial Sequence: Synthetic oligonucleotide"
cttgtggaaaggacgaaacaccgtaatttctactcttgtagatacagaggaggacaaggctac

SEQ ID NO: 56 - DNA, 99 bp, Artificial Sequence
  source: /note="Description of Artificial Sequence: Synthetic oligonucleotide"
cttgtggaaaggacgaaacaccgggccaacatgaggatcacccatgtctgcagggccagtaatttctactcttgtagatacagaggaggacaaggctac

SEQ ID NO: 57 - DNA, 99 bp, Artificial Sequence
  source: /note="Description of Artificial Sequence: Synthetic oligonucleotide"
cttgtggaaaggacgaaacaccgtaatttctactggccaacatgaggatcacccatgtctgcagggccagcttgtagatacagaggaggacaaggctac

SEQ ID NO: 58 - DNA, 99 bp, Artificial Sequence
  source: /note="Description of Artificial Sequence: Synthetic oligonucleotide"
cttgtggaaaggacgaaacaccgtaatttctactcttgtagatacagaggaggacaaggctacggccaacatgaggatcacccatgtctgcagggccag

SEQ ID NO: 59 - DNA, 64 bp, Artificial Sequence
  source: /note="Description of Artificial Sequence: Synthetic oligonucleotide"
cttgtggaaaggacgaaacaccgtaatttctactaagtgtagatgccagggaccgtttcagaca

SEQ ID NO: 60 - DNA, 100 bp, Artificial Sequence
  source: /note="Description of Artificial Sequence: Synthetic polynucleotide"
cttgtggaaaggacgaaacaccgggccaacatgaggatcacccatgtctgcagggccagtaatttctactaagtgtagatgccagggaccgtttcagaca

SEQ ID NO: 61 - DNA, 100 bp, Artificial Sequence
  source: /note="Description of Artificial Sequence: Synthetic polynucleotide"
cttgtggaaaggacgaaacaccgtaatttctactggccaacatgaggatcacccatgtctgcagggccagaagtgtagatgccagggaccgtttcagaca

SEQ ID NO: 62 - DNA, 100 bp, Artificial Sequence
  source: /note="Description of Artificial Sequence: Synthetic polynucleotide"
cttgtggaaaggacgaaacaccgtaatttctactaagtgtagatgccagggaccgtttcagacaggccaacatgaggatcacccatgtctgcagggccag

SEQ ID NO: 63 - DNA, 64 bp, Artificial Sequence
  source: /note="Description of Artificial Sequence: Synthetic oligonucleotide"
cttgtggaaaggacgaaacaccgtaatttctactaagtgtagatccttgtcaaggctattggtc

SEQ ID NO: 64 - DNA, 100 bp, Artificial Sequence
  source: /note="Description of Artificial Sequence: Synthetic polynucleotide"
cttgtggaaaggacgaaacaccgggccaacatgaggatcacccatgtctgcagggccagtaatttctactaagtgtagatccttgtcaaggctattggtc

SEQ ID NO: 65 - DNA, 100 bp, Artificial Sequence
  source: /note="Description of Artificial Sequence: Synthetic polynucleotide"
cttgtggaaaggacgaaacaccgtaatttctactggccaacatgaggatcacccatgtctgcagggccagaagtgtagatccttgtcaaggctattggtc

SEQ ID NO: 66 - DNA, 100 bp, Artificial Sequence
  source: /note="Description of Artificial Sequence: Synthetic polynucleotide"
cttgtggaaaggacgaaacaccgtaatttctactaagtgtagatccttgtcaaggctattggtcggccaacatgaggatcacccatgtctgcagggccag

SEQ ID NO: 67 - DNA, 64 bp, Artificial Sequence
  source: /note="Description of Artificial Sequence: Synthetic oligonucleotide"
cttgtggaaaggacgaaacaccgtaatttctactaagtgtagatttcttcatccctagccagcc

SEQ ID NO: 68 - protein, 1477 aa, Unknown
  source: /note="Description of Unknown: Peregrinibacteria bacterium polypeptide"
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEDKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAIMKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTEIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDCWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKK

SEQ ID NO: 69 - protein, 1403 aa, Unknown
  source: /note="Description of Unknown: Parcubacteria (Falkowbacteria) bacterium polypeptide"
MLFFMSTDITNKPREKGVFDNFTNLYEFSKTLTFGLIPLKWDDNKKMIVEDEDFSVLRKYGVIEEDKRIAESIKIAKFYLNILHRELIGKVLGSLKFEKKNLENYDRLLGEIEKNNKNENISEDKKKEIRKNFKKELSIAQDILLKKVGEVFESNGSGILSSKNCLDELTKRFTRQEVDKLRRENKDIGVEYPDVAYREKDGKEETKSFFAMDVGYLDDFHKNRKQLYSVKGKKNSLGRRILDNFEIFCKNKKLYEKYKNLDIDFSEIERNFNLTLEKVFDFDNYNERLTQEGLDEYAKILGGESNKQERTANIHGLNQIINLYIQKKQSEQKAEQKETGKKKIKFNKKDYPTFTCLQKQILSQVFRKEIIIESDRDLIRELKFFVEESKEKVDKARGIIEFLLNHEENDIDLAMVYLPKSKINSFVYKVFKEPQDFLSVFQDGASNLDFVSFDKIKTHLENNKLTYKIFFKTLIKENHDFESFLILLQQEIDLLIDGGETVTLGGKKESITSLDEKKNRLKEKLGWFEGKVRENEKMKDEEEGEFCSTVLAYSQAVLNITKRAEIFWLNEKQDAKVGEDNKDMIFYKKFDEFADDGFAPFFYFDKFGNYLKRRSRNTTKEIKLHFGNDDLLEGWDMNKEPEYWSFILRDRNQYYLGIGKKDGEIFHKKLGNSVEAVKEAYELENEADFYEKIDYKQLNIDRFEGIAFPKKTKTEEAFRQVCKKRADEFLGGDTYEFKILLAIKKEYDDFKARRQKEKDWDSKFSKEKMSKLIEYYITCLGKRDDWKRFNLNFRQPKEYEDRSDFVRHIQRQAYWIDPRKVSKDYVDKKVAEGEMFLFKVHNKDFYDFERKSEDKKNHTANLFTQYLLELFSCENIKNIKSKDLIESIFELDGKAEIRFRPKTDDVKLKIYQKKGKDVTYADKRDGNKEKEVIQHRRFAKDALTLHLKIRLNFGKHVNLFDFNKLVNTELFAKVPVKILGMDRGENNLIYYCFLDEHGEIENGKCGSLNRVGEQIITLEDDKKVKEPVDYFQLLVDREGQRDWEQKNWQKMTRIKDLKKAYLGNVVSWISKEMLSGIKEGVVTIGVLEDLNSNFKRTRFFRERQVYQGFEKALVNKLGYLVDKKYDNYRNVYQFAPIVDSVEEMEKNKQIGTLVYVPASYTSKICPHPKCGWRERLYMKNSASKEKIVGLLKSDGIKISYDQKNDRFYFEYQWEQEHKSDGKKKKYSGVDKVFSNVSRMRWDVEQKKSIDFVDGTDGSITNKLKSLLKGKGIELDNINQQIVNQQKELGVEFFQSIIFYFNLIMQIRNYDKEKSGSEADYIQCPSCLFDSRKPEMNGKLSAITNGDANGAYNIARKGFMQLCRIRENPQEPMKLITNREWDEAVREWDIYSAAQKIPVLSEEN

SEQ ID NO: 70 - protein, 1373 aa, Moraxella bovoculi
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 71 - protein, 1352 aa, Unknown
  source: /note="Description of Unknown: Parcubacteria bacterium polypeptide"
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 72 - protein, 1334 aa, Succinivibrio dextrinosolvens
MSSLTKFTNKYSKQLTIKNELIPVGKTLENIKENGLIDGDEQLNENYQKAKIIVDDFLRDFINKALNNTQIGNWRELADALNKEDEDNIEKLQDKIRGIIVSKFETFDLFSSYSIKKDEKIIDDDNDVEEEELDLGKKTSSFKYIFKKNLFKLVLPSYLKTTNQDKLKIISSFDNFSTYFRGFFENRKNIFTKKPISTSIAYRIVHDNFPKFLDNIRCFNVWQTECPQLIVKADNYLKSKNVIAKDKSLANYFTVGAYDYFLSQNGIDFYNNIIGGLPAFAGHEKIQGLNEFINQECQKDSELKSKLKNRHAFKMAVLFKQILSDREKSFVIDEFESDAQVIDAVKNFYAEQCKDNNVIFNLLNLIKNIAFLSDDELDGIFIEGKYLSSVSQKLYSDWSKLRNDIEDSANSKQGNKELAKKIKTNKGDVEKAISKYEFSLSELNSIVHDNTKFSDLLSCTLHKVASEKLVKVNEGDWPKHLKNNEEKQKIKEPLDALLEIYNTLLIFNCKSFNKNGNFYVDYDRCINELSSVVYLYNKTRNYCTKKPYNTDKFKLNFNSPQLGEGFSKSKENDCLTLLFKKDDNYYVGIIRKGAKINFDDTQAIADNTDNCIFKMNYFLLKDAKKFIPKCSIQLKEVKAHFKKSEDDYILSDKEKFASPLVIKKSTFLLATAHVKGKKGNIKKFQKEYSKENPTEYRNSLNEWIAFCKEFLKTYKAATIFDITTLKKAEEYADIVEFYKDVDNLCYKLEFCPIKTSFIENLIDNGDLYLFRINNKDFSSKSTGTKNLHTLYLQAIFDERNLNNPTIMLNGGAELFYRKESIEQKNRITHKAGSILVNKVCKDGTSLDDKIRNEIYQYENKFIDTLSDEAKKVLPNVIKKEATHDITKDKRFTSDKFFFHCPLTINYKEGDTKQFNNEVLSFLRGNPDINIIGIDRGERNLIYVTVINQKGEILDSVSFNTVTNKSSKIEQTVDYEEKLAVREKERIEAKRSWDSISKIATLKEGYLSAIVHEICLLMIKHNAIVVLENLNAGFKRIRGGLSEKSVYQKFEKMLINKLNYFVSKKESDWNKPSGLLNGLQLSDQFESFEKLGIQSGFIFYVPAAYTSKIDPTTGFANVLNLSKVRNVDAIKSFFSNFNEISYSKKEALFKFSFDLDSLSKKGFSSFVKFSKSKWNVYTFGERIIKPKNKQGYREDKRINLTFEMKKLLNEYKVSFDLENNLIPNLTSANLKDTFWKELFFIFKTTLQLRNSVTNGKEDVLISPVKNAKGEFFVSGTHNKTLPQDCDANGAYHIALKGLMILERNNLVREEKDTKKIMAISNVDWFEYVQKRRGVL

SEQ ID NO: 73 - protein, 1331 aa, Unknown
  source: /note="Description of Unknown: Parcubacteria bacterium polypeptide"
MKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 74 - protein, 1323 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLK

SEQ ID NO: 75 - protein, 1318 aa, Flavobacterium branchiophilum
MTNKFTNQYSLSKTLRFELIPQGKTLEFIQEKGLLSQDKQRAESYQEMKKTIDKFHKYFIDLALSNAKLTHLETYLELYNKSAETKKEQKFKDDLKKVQDNLRKEIVKSFSDGDAKSIFAILDKKELITVELEKWFENNEQKDIYFDEKFKTFTTYFTGFHQNRKNMYSVEPNSTAIAYRLIHENLPKFLENAKAFEKIKQVESLQVNFRELMGEFGDEGLIFVNELEEMFQINYYNDVLSQNGITIYNSIISGFTKNDIKYKGLNEYINNYNQTKDKKDRLPKLKQLYKQILSDRISLSFLPDAFTDGKQVLKAIFDFYKINLLSYTIEGQEESQNLLLLIRQTIENLSSFDTQKIYLKNDTHLTTISQQVFGDFSVFSTALNYWYETKVNPKFETEYSKANEKKREILDKAKAVFTKQDYFSIAFLQEVLSEYILTLDHTSDIVKKHSSNCIADYFKNHFVAKKENETDKTFDFIANITAKYQCIQGILENADQYEDELKQDQKLIDNLKFFLDAILELLHFIKPLHLKSESITEKDTAFYDVFENYYEALSLLTPLYNMVRNYVTQKPYSTEKIKLNFENAQLLNGWDANKEGDYLTTILKKDGNYFLAIMDKKHNKAFQKFPEGKENYEKMVYKLLPGVNKMLPKVFFSNKNIAYFNPSKELLENYKKETHKKGDTFNLEHCHTLIDFFKDSLNKHEDWKYFDFQFSETKSYQDLSGFYREVEHQGYKINFKNIDSEYIDGLVNEGKLFLFQIYSKDFSPFSKGKPNMHTLYWKALFEEQNLQNVIYKLNGQAEIFFRKASIKPKNIILHKKKIKIAKKHFIDKKTKTSEIVPVQTIKNLNMYYQGKISEKELTQDDLRYIDNFSIFNEKNKTIDIIKDKRFTVDKFQFHVPITMNFKATGGSYINQTVLEYLQNNPEVKIIGLDRGERHLVYLTLIDQQGNILKQESLNTITDSKISTPYHKLLDNKENERDLARKNWGTVENIKELKEGYISQVVHKIATLMLEENAIVVMEDLNFGFKRGRFKVEKQIYQKLEKMLIDKLNYLVLKDKQPQELGGLYNALQLTNKFESFQKMGKQSGFLFYVPAWNTSKIDPTTGFVNYFYTKYENVDKAKAFFEKFEAIRFNAEKKYFEFEVKKYSDFNPKAEGTQQAWTICTYGERIETKRQKDQNNKFVSTPINLTEKIEDFLGKNQIVYGDGNCIKSQIASKDDKAFFETLLYWFKMTLQMRNSETRTDIDYLISPVMNDNGTFYNSRDYEKLENPTLPKDADANGAYHIAKKGLMLLNKIDQADLTKKVDLSISNRDWLQFVQKNK

SEQ ID NO: 76 - protein, 1310 aa, Helcococcus kunzii
MFEKLSNIVSISKTIRFKLIPVGKTLENIEKLGKLEKDFERSDFYPILKNISDDYYRQYIKEKLSDLNLDWQKLYDAHELLDSSKKESQKNLEMIQAQYRKVLFNILSGELDKSGEKNSKDLIKNNKALYGKLFKKQFILEVLPDFVNNNDSYSEEDLEGLNLYSKFTTRLKNFWETRKNVFTDKDIVTAIPFRAVNENFGFYYDNIKIFNKNIEYLENKIPNLENELKEADILDDNRSVKDYFTPNGFNYVITQDGIDVYQAIRGGFTKENGEKVQGINEILNLTQQQLRRKPETKNVKLGVLTKLRKQILEYSESTSFLIDQIEDDNDLVDRINKFNVSFFESTEVSPSLFEQIERLYNALKSIKKEEVYIDARNTQKFSQMLFGQWDVIRRGYTVKITEGSKEEKKKYKEYLELDETSKAKRYLNIREIEELVNLVEGFEEVDVFSVLLEKFKMNNIERSEFEAPIYGSPIKLEAIKEYLEKHLEEYHKWKLLLIGNDDLDTDETFYPLLNEVISDYYIIPLYNLTRNYLTRKHSDKDKIKVNFDFPTLADGWSESKISDNRSIILRKGGYYYLGILIDNKLLINKKNKSKKIYEILIYNQIPEFSKSIPNYPFTKKVKEHFKNNVSDFQLIDGYVSPLIITKEIYDIKKEKKYKKDFYKDNNTNKNYLYTIYKWIEFCKQFLYKYKGPNKESYKEMYDFSTLKDTSLYVNLNDFYADVNSCAYRVLFNKIDENTIDNAVEDGKLLLFQIYNKDFSPESKGKKNLHTLYWLSMFSEENLRTRKLKLNGQAEIFYRKKLEKKPIIHKEGSILLNKIDKEGNTIPENIYHECYRYLNKKIGREDLSDEAIALFNKDVLKYKEARFDIIKDRRYSESQFFFHVPITFNWDIKTNKNVNQIVQGMIKDGEIKHIIGIDRGERHLLYYSVIDLEGNIVEQGSLNTLEQNRFDNSTVKVDYQNKLRTREEDRDRARKNWTNINKIKELKDGYLSHVVHKLSRLIIKYEAIVIMENLNQGFKRGRFKVERQVYQKFELALMNKLSALSFKEKYDERKNLEPSGILNPIQACYPVDAYQELQGQNGIVFYLPAAYTSVIDPVTGFTNLFRLKSINSSKYEEFIKKFKNIYFDNEEEDFKFIFNYKDFAKANLVILNNIKSKDWKISTRGERISYNSKKKEYFYVQPTEFLINKLKELNIDYENIDIIPLIDNLEEKAKRKILKALFDTFKYSVQLRNYDFENDYIISPTADDNGNYYNSNEIDIDKTNLPNNGDANGAFNIARKGLLLKDRIVNSNESKVDLKIKNEDWINFIIS

SEQ ID NO: 77 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 78 - protein, 1307 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNKESANTAILFIKDDKYYLGIMDKKHNKIFSDKAIEENKGEGYKKIVYKQIADASKDIQNLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 79 - protein, 1305 aa, Eubacterium sp.
MNKAADNYTGGNYDEFIALSKVQKTLRNELKPTPFTAEHIKQRGIISEDEYRAQQSLELKKIADEYYRNYITHKLNDINNLDFYNLFDAIEEKYKKNDKDNRDKLDLVEKSKRGEIAKMLSADDNFKSMFEAKLITKLLPDYVERNYTGEDKEKALETLALFKGFTTYFKGYFKTRKNMFSGEGGASSICHRIVNVNASIFYDNLKTFMRIQEKAGDEIALIEEELTEKLDGWRLEHIFSRDYYNEVLAQKGIDYYNQICGDINKHMNLYCQQNKFKANIFKMMKIQKQIMGISEKAFEIPPMYQNDEEVYASFNEFISRLEEVKLTDRLINILQNINIYNTAKIYINARYYTNVSSYVYGGWGVIDSAIERYLYNTIAGKGQSKVKKIENAKKDNKFMSVKELDSIVAEYEPDYFNAPYIDDDDNAVKAFGGQGVLGYFNKMSELLADVSLYTIDYNSDDSLIENKESALRIKKQLDDIMSLYHWLQTFIIDEVVEKDNAFYAELEDICCELENVVTLYDRIRNYVTKKPYSTQKFKLNFASPTLAAGWSRSKEFDNNAIILLRNNKYYIAIFNVNNKPDKQIIKGSEEQRLSTDYKKMVYNLLPGPNKMLPKVFIKSDTGKRDYNPSSYILEGYEKNRHIKSSGNFDINYCHDLIDYYKACINKHPEWKNYGFKFKETNQYNDIGQFYKDVEKQGYSISWAYISEEDINKLDEEGKIYLFEIYNKDLSAHSTGRDNLHTMYLKNIFSEDNLKNICIELNGEAELFYRKSSMKSNITHKKDTILVNKTYINETGVRVSLSDEDYMKVYNYYNNNYVIDTENDKNLIDIIEKIGHRKSKIDIVKDKRYTEDKYFLYLPITINYGIEDENVNSKIIEYIAKQDNMNVIGIDRGERNLIYISVIDNKGNIIEQKSFNLVNNYDYKNKLKNMEKTRDNARKNWQEIGKIKDVKSGYLSGVISKIARMVIDYNAIIVMEDLNKGFKRGRFKVERQVYQKFENMLISKLNYLVFKERKADENGGILRGYQLTYIPKSIKNVGKQCGCIFYVPAAYTSKIDPATGFINIFDFKKYSGSGINAKVKDKKEFLMSMNSIRYINECSEEYEKIGHRELFAFSFDYNNFKTYNVSSPVNEWTAYTYGERIKKLYKDGRWLRSEVLNLTENLIKLMEQYNIEYKDGHDIREDISHMDETRNADFICSLFEELKYTVQLRNSKSEAEDENYDRLVSPILNSSNGFYDSSDYMENENNTTHTMPKDADANGAYCIALKGLYEINKIKQNWSDDKKFKENELYINVTEWLDYIQNRRFE

SEQ ID NO: 80 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHRLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGNPQKGYEKFEFNIEDCRKFIDFYKESISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKKSIPKKITHPAKEAIANKNKDNPKKESFFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEHNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSILNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 81 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSDDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILANFAAIPMIFDEIAQNKDNLAQISLKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGNPQKGYEKFEFNIEDCRKFIDFYKESISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEHNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 82 - protein, 1300 aa, Francisella tularensis; identical to SEQ ID NO: 51

SEQ ID NO: 83 - protein, 1285 aa, Unknown
  source: /note="Description of Unknown: Microgenomates (Roizmanbacteria) bacterium polypeptide"
MKSFDSFTNLYSLSKTLKFEMRPVGNTQKMLDNAGVFEKDKLIQKKYGKTKPYFDRLHREFIEEALTGVELIGLDENFRTLVDWQKDKKNNVAMKAYENSLQRLRTEIGKIFNLKAEDWVKNKYPILGLKNKNTDILFEEAVFGILKARYGEEKDTFIEVEEIDKTGKSKINQISIFDSWKGFTGYFKKFFETRKNFYKNDGTSTAIATRIIDQNLKRFIDNLSIVESVRQKVDLAETEKSFSISLSQFFSIDFYNKCLLQDGIDYYNKIIGGETLKNGEKLIGLNELINQYRQNNKDQKIPFFKLLDKQILSEKILFLDEIKNDTELIEALSQFAKTAEEKTKIVKKLFADFVENNSKYDLAQIYISQEAFNTISNKWTSETETFAKYLFEAMKSGKLAKYEKKDNSYKFPDFIALSQMKSALLSISLEGHFWKEKYYKISKFQEKTNWEQFLAIFLYEFNSLFSDKINTKDGETKQVGYYLFAKDLHNLILSEQIDIPKDSKVTIKDFADSVLTIYQMAKYFAVEKKRAWLAEYELDSFYTQPDTGYLQFYDNAYEDIVQVYNKLRNYLTKKPYSEEKWKLNFENSTLANGWDKNKESDNSAVILQKGGKYYLGLITKGHNKIFDDRFQEKFIVGIEGGKYEKIVYKFFPDQAKMFPKVCFSAKGLEFFRPSEEILRIYNNAEFKKGETYSIDSMQKLIDFYKDCLTKYEGWACYTFRHLKPTEEYQNNIGEFFRDVAEDGYRIDFQGISDQYIHEKNEKGELHLFEIHNKDWNLDKARDGKSKTTQKNLHTLYFESLFSNDNVVQNFPIKLNGQAEIFYRPKTEKDKLESKKDKKGNKVIDHKRYSENKIFFHVPLTLNRTKNDSYRFNAQINNFLANNKDINIIGVDRGEKHLVYYSVITQASDILESGSLNELNGVNYAEKLGKKAENREQARRDWQDVQGIKDLKKGYISQVVRKLADLAIKHNAIIILEDLNMRFKQVRGGIEKSIYQQLEKALIDKLSFLVDKGEKNPEQAGHLLKAYQLSAPFETFQKMGKQTGIIFYTQASYTSKSDPVTGWRPHLYLKYFSAKKAKDDIAKFTKIEFVNDRFELTYDIKDFQQAKEYPNKTVWKVCSNVERFRWDKNLNQNKGGYTHYTNITENIQELFTKYGIDITKDLLTQISTIDEKQNTSFFRDFIFYFNLICQIRNTDDSEIAKKNGKDDFILSPVEPFFDSRKDNGNKLPENGDDNGAYNIARKGIVILNKISQYSEKNENCEKMKWGDLYVSNIDWDNFVTQANARH

SEQ ID NO: 84 - protein, 1282 aa, Eubacterium eligens
MNGNRSIVYREFVGVTPVAKTLRNELRPVGHTQEHIIQNGLIQEDELRQEKSTELKNIMDDYYREYIDKSLSGLTDLDFTLLFELMNSVQSSLSKDNKKALEKEHNKMREQICTHLQSDSDYKNMFNAKLFKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDEHISLIESEEKADEIKKRLDMYMNMYHWVKAFIVDEVLDRDEMFYSDIDDIYNILENIVPLYNRVRNYVTQKPYTSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKDFAENSTGKENLHTMYFKNIFSEENLKNIVIKLNGQAELFYRKASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDVRIDMEKMYEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 85 - protein, 1282 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 86 - protein, 1273 aa, Flavobacterium sp.
MKNFSNLYQVSKTVRFELKPIGNTLENIKNKSLLKNDSIRAESYQKMKKTIDEFHKYFIDLALNNKKLSYLNEYIALYTQSAEAKKEDKFKADFKKVQDNLRKEIVSSFTEGEAKAIFSVLDKKELITIELEKWKNENNLAVYLDESFKSFTTYFTGFHQNRKNMYSAEANSTAIAYRLIHENLPKFIENSKAFEKSSQIAELQPKIEKLYKEFEAYLNVNSISELFEIDYFNEVLTQKGITVYNNIIGGRTATEGKQKIQGLNEIINLYNQTKPKNERLPKLKQLYKQILSDRISLSFLPDAFTEGKQVLKAVFEFYKINLLSYKQDGVEESQNLLELIQQVVKNLGNQDVNKIYLKNDTSLTTIAQQLFGDFSVFSAALQYRYETVVNPKYTAEYQKANEAKQEKLDKEKIKFVKQDYFSIAFLQEVVADYVKTLDENLDWKQKYTPSCIADYFTTHFIAKKENEADKTFNFIANIKAKYQCIQGILEQADDYEDELKQDQKLIDNIKFFLDAILEVVHFIKPLHLKSESITEKDNAFYDVFENYYEALNVVTPLYNMVRNYVTQKPYSTEKIKLNFENAQLLNGWDANKEKDYLTTILKRDGNYFLAIMDKKHNKTFQQFTEDDENYEKIVYKLLPGVNKMLPKVFFSNKNIAFFNPSKEILDNYKNNTHKKGATFNLKDCHALIDFFKDSLNKHEDWKYFDFQFSETKTYQDLSGFYKEVEHQGYKINFKKVSVSQIDTLIEEGKMYLFQIYNKDFSPYAKGKPNMHTLYWKALFETQNLENVIYKLNGQAEIFFRKASIKKKNIITHKAHQPIAAKNPLTPTAKNTFAYDLIKDKRYTVDKFQFHVPITMNFKATGNSYINQDVLAYLKDNPEVNIIGLDRGERHLVYLTLIDQKGTILLQESLNVIQDEKTHTPYHTLLDNKEIARDKARKNWGSIESIKELKEGYISQVVHKITKMMIEHNAIVVMEDLNFGFKRGRFKVEKQIYQKLEKMLIDKLNYLVLKDKQPHELGGLYNALQLTNKFESFQKMGKQSGFLFYVPAWNTSKIDPTTGFVNYFYTKYENVEKAKTFFSKFDSILYNKTKGYFEFVVKNYSDFNPKAADTRQEWTICTHGERIETKRQKEQNNNFVSTTIQLTEQFVNFFEKVGLDLSKELKTQLIAQNEKSFFEELFHLLKLTLQMRNSESHTEIDYLISPVANEKGIFYDSRKATASLPIDADANGAYHIAKKGLWIMEQINKTNSEDDLKKVKLAISNREWLQYVQQVQKK

SEQ ID NO: 87 - protein, 1264 aa, Prevotella brevis
MKQFTNLYQLSKTLRFELKPIGKTLEHINANGFIDNDAHRAESYKKVKKLIDDYHKDYIENVLNNFKLNGEYLQAYFDLYSQDTKDKQFKDIQDKLRKSIASALKGDDRYKTIDKKELIRQDMKTFLKKDTDKALLDEFYEFTTYFTGYHENRKNMYSDEAKSTAIAYRLIHDNLPKFIDNIAVFKKIANTSVADNFSTIYKNFEEYLNVNSIDEIFSLDYYNIVLTQTQIEVYNSIIGGRTLEDDTKIQGINEFVNLYNQQLANKKDRLPKLKPLFKQILSDRVQLSWLQEEFNTGADVLNAVKEYCTSYFDNVEESVKVLLTGISDYDLSKIYITNDLALTDVSQRMFGEWSIIPNAIEQRLRSDNPKKTNEKEEKYSDRISKLKKLPKSYSLGYINECISELNGIDIADYYATLGAINTESKQEPSIPTSIQVHYNALKPILDTDYPREKNLSQDKLTVMQLKDLLDDFKALQHFIKPLLGNGDEAEKDEKFYGELMQLWEVIDSITPLYNKVRNYCTRKPFSTEKIKVNFENAQLLDGWDENKESTNASIILRKNGMYYLGIMKKEYRNILTKPMPSDGDCYDKVVYKFFKDITTMVPKCTTQMKSVKEHFSNSNDDYTLFEKDKFIAPVVITKEIFDLNNVLYNGVKKFQIGYLNNTGDSFGYNHAVEIWKSFCLKFLKAYKSTSIYDFSSIEKNIGCYNDLNSFYGAVNLLLYNLTYRKVSVDYIHQLVDEDKMYLFMIYNKDFSTYSKGTPNMHTLYWKMLFDESNLNDVVYKLNGQAEVFYRKKSITYQHPTHPANKPIDNKNVNNPKKQSNFEYDLIKDKRYTVDKFMFHVPITLNFKGMGNGDINMQVREYIKTTDDLHFIGIDRGERHLLYICVINGKGEIVEQYSLNEIVNNYKGTEYKTDYHTLLSERDKKRKEERSSWQTIEGIKELKSGYLSQVIHKITQLMIKYNAIVLLEDLNMGFKRGRQKVESSVYQQFEKALIDKLNYLVDKNKDANEIGGLLHAYQLTNDPKLPNKNSKQSGFLFYVPAWNTSKIDPVTGFVNLLDTRYENVAKAQAFFKKFDSIRYNKEYDRFEFKFDYSNFTAKAEDTRTQWTLCTYGTRIETFRNAEKNSNWDSREIDLTTEWKTLFTQHNIPLNANLKEAILLQANKNFYTDILHLMKLTLQMRNSVTGTDIDYMVSPVANECGEFFDSRKVKEGLPVNADANGAYNIARKGLWLAQQIKNANDLSDVKLAITNKEWLQFAQKKQYLKD

SEQ ID NO: 88 - protein, 1264 aa, Moraxella caprae
MLFQDFTHLYPLSKTMRFELKPIGKTLEHIHAKNFLSQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAITYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGALYDELAKIPTLYNKVRDYLSQKPFSTEKYKLNFGNPTLLNGWDLNKEKDNFGIILQKDGCYYLALLDKAHKKVFDNAPNTGKNVYQKMIYKLLPGPNKMLPKVFFAKSNLDYYNPSAELLDKYAQGTHKKGNNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSKDNLANPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDEADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWKICSHGDKRYVYDKTANQNKGATKGINVNDELKSLFARHHINDKQPNLVMDICQNNDKEFHKSLIYLLKTLLALRYSNASSDEDFILSPVANDEGMFFNSALADDTQPQNADANGAYHIALKGLWVLEQIKNSDDLNKVKLAIDNQTWLNFAQNR

SEQ ID NO: 89 - protein, 1263 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 90 - protein, 1262 aa, Porphyromonas crevioricanis
MPWIDLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKVLPEYKEGEPYFEKMDYKFLPDPNKMLPKVFLSKKGIEIYEPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQERRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHAQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 91 - protein, 1262 aa, Unknown
  source: /note="Description of Unknown: Bacteroidetes polypeptide"
MRKFNEFVGLYPISKTLRFELKPIGKTLEHIQRNKLLEHDAVRADDYVKVKKIIDKYHKCLIDEALSGFTFDTEADGRSNNSLSEYYLYYNLKKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNIAAFEKVVSSPLAEKINALYEDFKEYLNVEEISRVFRLDYYDELLTQKQIDLYNAIVGGRTEEDNKIQIKGLNQYINEYNQQQTDRSNRLPKLKPLYKQILSDRESVSWLPPKFDSDKNLLIKIKECYDALSEKEKVFDKLESILKSLSTYDLSKIYISNDSQLSYISQKMFGRWDIISKAIREDCAKRNPQKSRESLEKFAERIDKKLKTIDSISIGDVDECLAQLGETYVKRVEDYFVAMGESEIDDEQTDTTSFKKNIEGAYESVKELLNNADNITDNNLMQDKGNVEKIKTLLDAIKDLQRFIKPLLGKGDEADKDGVFYGEFTSLWTKLDQVTPLYNMVRNYLTSKPYSTKKIKLNFENSTLMDGWDLNKEPDNTTVIFCKDGLYYLGIMGKKYNRVFVDREDLPHDGECYDKMEYKLLPGANKMLPKVFFSETGIQRFLPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESKFEYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKVFFDKFKSIRYNSDKDWFEFVVDDYTRFSPKAEGTRRDWTICTQGKRIQICRNHQRNNEWEGQEIDLTKAFKEHFEAYGVDISKDLREQINTQNKKEFFEELLRLLRLTLQMRNSMPSSDIDYLISPVANDTGCFFDSRKQAELKENAVLPMNADANGAYNIARKGLLAIRKMKQEENDSAKISLAISNKEWLKFAQTKPYLED

SEQ ID NO: 92 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 93 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKVLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRHYTMDKFQFHVPITMNFKCSAGSKVNDMVNAHIREAKDMHVIGIDRGERNLLYICVIDSRGTILDQISLNTINDIDYHDLLESRDKDRQQERRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHAQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 94 - protein, 1260 aa, Porphyromonas cansulci
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKVLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQERRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHAQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 95 - protein, 1259 aa, Synergistes jonesii
MANSLKDFTNIYQLSKTLRFELKPIGKTEEHINRKLIIMHDEKRGEDYKSVTKLIDDYHRKFIHETLDPAHFDWNPLAEALIQSGSKNNKALPAEQKEMREKIISMFTSQAVYKKLFKKELFSELLPEMIKSELVSDLEKQAQLDAVKSFDKFSTYFTGFHENRKNIYSKKDTSTSIAFRIVHQNFPKFLANVRAYTLIKERAPEVIDKAQKELSGILGGKTLDDIFSIESFNNVLTQDKIDYYNQIIGGVSGKAGDKKLRGVNEFSNLYRQQHPEVASLRIKMVPLYKQILSDRTTLSFVPEALKDDEQAINAVDGLRSELERNDIFNRIKRLFGKNNLYSLDKIWIKNSSISAFSNELFKNWSFIEDALKEFKENEFNGARSAGKKAEKWLKSKYFSFADIDAAVKSYSEQVSADISSAPSASYFAKFTNLIETAAENGRKFSYFAAESKAFRGDDGKTEIIKAYLDSLNDILHCLKPFETEDISDIDTEFYSAFAEIYDSVKDVIPVYNAVRNYTTQKPFSTEKFKLNFENPALAKGWDKNKEQNNTAIILMKDGKYYLGVIDKNNKLRADDLADDGSAYGYMKMNYKFIPTPHMELPKVFLPKRAPKRYNPSREILLIKENKTFIKDKNFNRTDCHKLIDFFKDSINKHKDWRTFGFDFSDTDSYEDISDFYMEVQDQGYKLTFTRLSAEKIDKWVEEGRLFLFQIYNKDFADGAQGSPNLHTLYWKAIFSEENLKDVVLKLNGEAELFFRRKSIDKPAVHAKGSMKVNRRDIDGNPIDEGTYVEICGYANGKRDMASLNAGARGLIESGLVRITEVKHELVKDKRYTIDKYFFHVPFTINFKAQGQGNINSDVNLFLRNNKDVNIIGIDRGERNLVYVSLIDRDGHIKLQKDFNIIGGMDYHAKLNQKEKERDTARKSWKTIGTIKELKEGYLSQVVHEIVRLAVDNNAVIVMEDLNIGFKRGRFKVEKQVYQKFEKMLIDKLNYLVFKDAGYDAPCGILKGLQLTEKFESFTKLGKQCGIIFYIPAGYTSKIDPTTGFVNLFNINDVSSKEKQKDFIGKLDSIRFDAKRDMFTFEFDYDKFRTYQTSYRKKWAVWTNGKRIVREKDKDGKFRMNDRLLTEDMKNILNKYALAYKAGEDILPDVISRDKSLASEIFYVFKNTLQMRNSKRDTGEDFIISPVLNAKGRFFDSRKTDAALPIDADANGAYHIALKGSLVLDAIDEKLKEDGRIDYKDMAVSNPKWFEFMQTRKFDF

SEQ ID NO: 96 - protein, 1257 aa, Prevotella bryantii
MQINNLKIIYMKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPKVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 97 - protein, 1253 aa, Prevotella albensis
MNIKNFTGLYPLSKTLRFELKPIGKTKENIEKNGILTKDEQRAKDYLIVKGFIDEYHKQFIKDRLWDFKLPLESEGEKNSLEEYQELYELTKRNDAQEADFTEIKDNLRSSITEQLTKSGSAYDRIFKKEFIREDLVNFLEDEKDKNIVKQFEDFTTYFTGFYENRKNMYSSEEKSTAIAYRLIHQNLPKFMDNMRSFAKIANSSVSEHFSDIYESWKEYLNVNSIEEIFQLDYFSETLTQPHIEVYNYIIGKKVLEDGTEIKGINEYVNLYNQQQKDKSKRLPFLVPLYKQILSDREKLSWIAEEFDSDKKMLSAITESYNHLHNVLMGNENESLRNLLLNIKDYNLEKINITNDLSLTEISQNLFGRYDVFTNGIKNKLRVLTPRKKKETDENFEDRINKIFKTQKSFSIAFLNKLPQPEMEDGKPRNIEDYFITQGAINTKSIQKEDIFAQIENAYEDAQVFLQIKDTDNKLSQNKTAVEKIKTLLDALKELQHFIKPLLGSGEENEKDELFYGSFLAIWDELDTITPLYNKVRNWLTRKPYSTEKIKLNFDNAQLLGGWDVNKEHDCAGILLRKNDSYYLGIINKKTNHIFDTDITPSDGECYDKIDYKLLPGANKMLPKVFFSKSRIKEFEPSEAIINCYKKGTHKKGKNFNLTDCHRLINFFKTSIEKHEDWSKFGFKFSDTETYEDISGFYREVEQQGYRLTSHPVSASYIHSLVKEGKLYLFQIWNKDFSQFSKGTPNLHTLYWKMLFDKRNLSDVVYKLNGQAEVFYRKSSIEHQNRIIHPAQHPITNKNELNKKHTSTFKYDIIKDRRYTVDKFQFHVPITINFKATGQNNINPIVQEVIRQNGITHIIGIDRGERHLLYLSLIDLKGNIIKQMTLNEIINEYKGVTYKTNYHNLLEKREKERTEARHSWSSIESIKELKDGYMSQVIHKITDMMVKYNAIVVLEDLNGGFMRGRQKVEKQVYQKFEKKLIDKLNYLVDKKLDANEVGGVLNAYQLTNKFESFKKIGKQSGFLFYIPAWNTSKIDPITGFVNLFNTRYESIKETKVFWSKFDIIRYNKEKNWFEFVFDYNTFTTKAEGTRTKWTLCTHGTRIQTFRNPEKNAQWDNKEINLTESFKALFEKYKIDITSNLKESIMQETEKKFFQELHNLLHLTLQMRNSVTGTDIDYLISPVADEDGNFYDSRINGKNFPENADANGAYNIARKGLMLIRQIKQADPQKKFKFETITNKDWLKFAQDKPYLKD

SEQ ID NO: 98 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYAWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 99 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEEYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKIYFRSGTSLTDVSRKVFGEWSIINRALDNYYATTYPIKPREKSEKYEERKEKWLKQDFNVSLIQTAIDEYDNETVKGKNSGKVIVDYFAKFCDDKETDLIQKVNEGYIAVKDLLNTPYPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKENLYYLGIMDKRHNRIFRNVPKADKKDSCYEKMVYKLLPGANKMLPKVFFSQSRIQEFTPSAKLLENYENETHKKGDNFNLNHCHQLIDFFKDSINKHEDWKNFDFRFSATSTYADLSGFYHEVEHQGYKISFQSIADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHVPITMNFKAEGIFNMNQRVNQFLKANPDINIIGIDRGERHLLYYTLINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLKQAKDFFEKFDSIRLNSKADYFEFAFDFKNFTGKADGGRTKWTVCTTNEDRYAWNRALNNNRGSQEKYDITAELKSLFDGKVDYKSGKDLKQQIASQELADFFRTLMKYLSVTLSLRHNNGEKGETEQDYILSPVADSMGKFFDSRKAGDDMPKNADANGAYHIALKGLWCLEQISKTDDLKKVKLAISNKEWLEFMQTLKG

SEQ ID NO: 100 - protein, 1247 aa, Prevotella bryantii
MKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPKVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 101 - protein, 1247 aa, Unknown
  source: /note="Description of Unknown: uncultured bacterium polypeptide"
MFKGDAFTGLYEVQKTLRFELVPIGLTQSYLENDWVIQKDKEVEENYGKIKAYFDLIHKEFVRQSLENAWLCQLDDFYEKYIELHNSLETRKDKNLAKQFEKVMKSLKKEFVSFFDAKWNEWKQKFSFLKKWWIDVLNEKEVLDLMAEFYPDEKELFDKFDKFFTYFSNFKESRKNFYADDGRAWAIATRAIDENLITFIKNIEDFKKLNSSFREFVNDNFSEEDKQIFEIDFYNNCLLQPWIDKYNKIVWWYSLENWEKVQWLNEKINNFKQNQNKSNSKDLKFPRMKLLYKQILGDKEKKVYIDEIRDDKNLIDLIDNSKRRNQIKIDNANDIINDFINNNAKFELDKIYLTRQSINTISSKYFSSWDYIRWYFWTGELQEFVSFYDLKETFWKIEYETLENIFKDCYVKGINTESQNNIVFETQGIYENFLNIFKFEFNQNISQISLLEWELDKIQNEDIKKNEKQVEVIKNYFDSVMSVYKMTKYFSLEKWKKRVELDTDNNFYNDFNEYLEGFEIWKDYNLVRNYITKKQVNTDKIKLNFDNSQFLTWWDKDKENERLGIILRREWKYYLWILKKWNTLNFGDYLQKEWEIFYEKMNYKQLNNVYRQLPRLLFPLTKKLNELKWDELKKYLSKYIQNFWYNEEIAQIKIEFDIFQESKEKWEKFDIDKLRKLIEYYKKWVLALYSDLYDLEFIKYKNYDDLSIFYSDVEKKMYNLNFTKIDKSLIDGKVKSWELYLFQIYNKDFSESKKEWSTENIHTKYFKLLFNEKNLQNLVVKLSWWADIFFRDKTENLKFKKDKNGQEILDHRRFSQDKIMFHISITLNANCWDKYWFNQYVNEYMNKERDIKIIWIDRWEKHLAYYCVIDKSWKIFNNEIWTLNELNWVNYLEKLEKIESSRKDSRISWWEIENIKELKNGYISQVINKLTELIVKYNAIIVFEDLNIWFKRWRQKIEKQIYQKLELALAKKLNYLTQKDKKDDEILWNLKALQLVPKVNDYQDIWNYKQSWIMFYVRANYTSVTCPNCWLRKNLYISNSATKENQKKSLNSIAIKYNDWKFSFSYEIDDKSWKQKQSLNKKKFIVYSDIERFVYSPLEKLTKVIDVNKKLLELFRDFNLSLDINKQIQEKDLDSVFFKSLTHLFNLILQLRNSDSKDNKDYISCPSCYYHSNNWLQWFEFNWDANWAYNIARKGIILLDRIRKNQEKPDLYVSDIDWDNFVQSNQFPNTIIPIQNIEKQVPLNIKI

SEQ ID NO: 102 - protein, 1246 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 103 - protein, 1241 aa, Butyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEKARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 104 - protein, 1238 aa, Methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 105 - protein, 1235 aa, Anaerovibrio sp.
MVAFIDEFVGQYPVSKTLRFEARPVPETKKWLESDQCSVLFNDQKRNEYYGVLKELLDDYYRAYIEDALTSFTLDKALLENAYDLYCNRDTNAFSSCCEKLRKDLVKAFGNLKDYLLGSDQLKDLVKLKAKVDAPAGKGKKKIEVDSRLINWLNNNAKYSAEDREKYIKAIESFEGFVTYLTNYKQARENMFSSEDKSTAIAFRVIDQNMVTYFGNIRIYEKIKAKYPELYSALKGFEKFFSPTAYSEILSQSKIDEYNYQCIGRPIDDADFKGVNSLINEYRQKNGIKARELPVMSMLYKQILSDRDNSFMSEVINRNEEAIECAKNGYKVSYALFNELLQLYKKIFTEDNYGNIYVKTQPLTELSQALFGDWSILRNALDNGKYDKDIINLAELEKYFSEYCKVLDADDAAKIQDKFNLKDYFIQKNALDATLPDLDKITQYKPHLDAMLQAIRKYKLFSMYNGRKKMDVPENGIDFSNEFNAIYDKLSEFSILYDRIRNFATKKPYSDEKMKLSFNMPTMLAGWDYNNETANGCFLFIKDGKYFLGVADSKSKNIFDFKKNPHLLDKYSSKDIYYKVKYKQVSGSAKMLPKVVFAGSNEKIFGHLISKRILEIREKKLYTAAAGDRKAVAEWIDFMKSAIAIHPEWNEYFKFKFKNTAEYDNANKFYEDIDKQTYSLEKVEIPTEYIDEMVSQHKLYLFQLYTKDFSDKKKKKGTDNLHTMYWHGVFSDENLKAVTEGTQPIIKLNGEAEMFMRNPSIEFQVTHEHNKPIANKNPLNTKKESVFNYDLIKDKRYTERKFYFHCPITLNFRADKPIKYNEKINRFVENNPDVCIIGIDRGERHLLYYTVINQTGDILEQGSLNKISGSYTNDKGEKVNKETDYHDLLDRKEKGKHVAQQAWETIENIKELKAGYLSQVVYKLTQLMLQYNAVIVLENLNVGFKRGRTKVEKQVYQKFEKAMIDKLNYLVFKDRGYEMNGSYAKGLQLTDKFESFDKIGKQTGCIYYVIPSYTSHIDPKTGFVNLLNAKLRYENITKAQDTIRKFDSISYNAKADYFEFAFDYRSFGVDMARNEWVVCTCGDLRWEYSAKTRETKAYSVTDRLKELFKAHGIDYVGGENLVSHITEVADKHFLSTLLFYLRLVLKMRYTVSGTENENDFILSPVEYAPGKFFDSREATSTEPMNADANGAYHIALKGLMTIRGIEDGKLHNYGKGGENAAWFKFMQNQEYKNNG

SEQ ID NO: 106 - protein, 1233 aa, Unknown
  source: /note="Description of Unknown: Lachnospiraceae bacterium polypeptide"
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKLLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 107 - protein, 1231 aa, Butyrivibrio fibrisolvens
MYYESLTKLYPIKKTIRNELVPIGKTLENIKKNNILEADEDRKIAYIRVKAIMDDYHKRLINEALSGFALIDLDKAANLYLSRSKSADDIESFSRFQDKLRKAIAKRLREHENFGKIGNKDIIPLLQKLSENEDDYNALESFKNFYTYFESYNDVRLNLYSDKEKSSTVAYRLINENLPRFLDNIRAYDAVQKAGITSEELSSEAQDGLFLVNTFNNVLIQDGINTYNEDIGKLNVAINLYNQKNASVQGFRKVPKMKVLYKQILSDREESFIDEFESDTELLDSLESHYANLAKYFGSNKVQLLFTALRESKGVNVYVKNDIAKTSFSNVVFGSWSRIDELINGEYDDNNNRKKDEKYYDKRQKELKKNKSYTIEKIITLSTEDVDVIGKYIEKLESDIDDIRFKGKNFYEAVLCGHDRSKKLSKNKGAVEAIKGYLDSVKDFERDLKLINGSGQELEKNLVVYGEQEAVLSELSGIDSLYNMTRNYLTKKPFSTEKIKLNFNKPTFLDGWDYGNEEAYLGFFMIKEGNYFLAVMDANWNKEFRNIPSVDKSDCYKKVIYKQISSPEKSIQNLMVIDGKTVKKNGRKEKEGIHSGENLILEELKNTYLPKKINDIRKRRSYLNGDTFSKKDLTEFIGYYKQRVIEYYNGYSFYFKSDDDYASFKEFQEDVGRQAYQISYVDVPVSFVDDLINSGKLYLFRVYNKDFSEYSKGRLNLHTLYFKMLFDERNLKNVVYKLNGQAEVFYRPSSIKKEELIVHRAGEEIKNKNPKRAAQKPTRRLDYDIVKDRRYSQDKFMLHTSIIMNFGAEENVSFNDIVNGVLRNEDKVNVIGIDRGERNLLYVVVIDPEGKILEQRSLNCITDSNLDIETDYHRLLDEKESDRKIARRDWTTIENIKELKAGYLSQVVHIVAELVLKYNAIICLEDLNFGFKRGRQKVEKQVYQKFEKMLIDKLNYLVMDKSREQLSPEKISGALNALQLTPDFKSFKVLGKQTGIIYYVPAYLTSKIDPMTGFANLFYVKYENVDKAKEFFSKFDSIKYNKDGKNWNTKGYFEFAFDYKKFTDRAYGRVSEWTVCTVGERIIKFKNKEKNNSYDDKVIDLTNSLKELFDSYKVTYESEVDLKDAILAIDDPAFYRDLTRRLQQTLQMRNSSCDGSRDYIISPVKNSKGEFFCSDNNDDTTPNDADANGAFNIARKGLWVLNEIRNSEEGSKINLAMSNAQWLEYAQDNTI

SEQ ID NO: 108 - protein, 1230 aa, Unknown
  source: /note="Description of Unknown: Lachnospiraceae bacterium polypeptide"
MHENNGKIADNFIGIYPVSKTLRFELKPVGKTQEYIEKHGILDEDLKRAGDYKSVKKIIDAYHKYFIDEALNGIQLDGLKNYYELYEKKRDNNEEKEFQKIQMSLRKQIVKRFSEHPQYKYLFKKELIKNVLPEFTKDNAEEQTLVKSFQEFTTYFEGFHQNRKNMYSDEEKSTAIAYRVVHQNLPKYIDNMRIFSMILNTDIRSDLTELFNNLKTKMDITIVEEYFAIDGFNKVVNQKGIDVYNTILGAFSTDDNTKIKGLNEYINLYNQKNKAKLPKLKPLFKQILSDRDKISFIPEQFDSDTEVLEAVDMFYNRLLQFVIENEGQITISKLLTNFSAYDLNKIYVKNDTTISAISNDLFDDWSYISKAVRENYDSENVDKNKRAAAYEEKKEKALSKIKMYSIEELNFFVKKYSCNECHIEGYFERRILEILDKMRYAYESCKILHDKGLINNISLCQDRQAISELKDFLDSIKEVQWLLKPLMIGQEQADKEEAFYTELLRIWEELEPITLLYNKVRNYVTKKPYTLEKVKLNFYKSTLLDGWDKNKEKDNLGIILLKDGQYYLGIMNRRNNKIADDAPLAKTDNVYRKMEYKLLTKVSANLPRIFLKDKYNPSEEMLEKYEKGTHLKGENFCIDDCRELIDFFKKGIKQYEDWGQFDFKFSDTESYDDISAFYKEVEHQGYKITFRDIDETYIDSLVNEGKLYLFQIYNKDFSPYSKGTKNLHTLYWEMLFSQQNLQNIVYKLNGNAEIFYRKASINQKDVVVHKADLPIKNKDPQNSKKESMFDYDIIKDKRFTCDKYQFHVPITMNFKALGENHFNRKVNRLIHDAENMHIIGIDRGERNLIYLCMIDMKGNIVKQISLNEIISYDKNKLEHKRNYHQLLKTREDENKSARQSWQTIHTIKELKEGYLSQVIHVITDLMVEYNAIVVLEDLNFGFKQGRQKFERQVYQKFEKMLIDKLNYLVDKSKGMDEDGGLLHAYQLTDEFKSFKQLGKQSGFLYYIPAWNTSKLDPTTGFVNLFYTKYESVEKSKEFINNFTSILYNQEREYFEFLFDYSAFTSKAEGSRLKWTVCSKGERVETYRNPKKNNEWDTQKIDLTFELKKLFNDYSISLLDGDLREQMGKIDKADFYKKFMKLFALIVQMRNSDEREDKLISPVLNKYGAFFETGKNERMPLDADANGAYNIARKGLWIIEKIKNTDVEQLDKVKLTISNKEWLQYAQEHIL

SEQ ID NO: 109 - protein, 1228 aa, Unknown
  source: /note="Description of Unknown: Lachnospiraceae bacterium polypeptide"
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 110 - protein, 1227 aa, Unknown
  source: /note="Description of Unknown: Candidatus Methanomethylophilus polypeptide"
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNKERDNKAAILRKDGKYYLAILDMKKDLSSIRTSDEDESSFEKMEYKLLPSPVKMLPKIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 111 - protein, 1224 aa, Unknown
  source: /note="Description of Unknown: Lachnospiraceae bacterium polypeptide"
MGLYDGFVNRYSVSKTLRFELIPQGRTREYIETNGILSDDEERAKDYKTIKRLIDEYHKDYISRCLKNVNISCLEEYYHLYNSSNRDKRHEELDALSDQMRGEIASFLTGNDEYKEQKSRDIIINERIINFASTDEELAAVKRFRKFTSYFTGFFTNRENMYSAEKKSTAIAHRIIDVNLPKYVDNIKAFNTAIEAGVFDIAEFESNFKAITDEHEVSDLLDITKYSRFIRNEDIIIYNTLLGGISMKDEKIQGLNELINLHNQKHPGKKVPLLKVLYKQILGDSQTHSFVDDQFEDDQQVINAVKAVTDTFSETLLGSLKIIINNIGHYDLDRIYIKAGQDITTLSKRALNDWHIITECLESEYDDKFPKNKKSDTYEEMRNRYVKSFKSFSIGRLNSLVTTYTEQACFLENYLGSFGGDTDKNCLTDFTNSLMEVEHLLNSEYPVTNRLITDYESVRILKRLLDSEMEVIHFLKPLLGNGNESDKDLVFYGEFEAEYEKLLPVIKVYNRVRNYLTRKPFSTEKIKLNFNSPTLLCGWSQSKEKEYMGVILRKDGQYYLGIMTPSNKKIFSEAPKPDEDCYEKMVLRYIPHPYQMLPKVFFSKSNIAFFNPSDEILRIKKQESFKKGKSFNRDDCHKFIDFYKDSINRHEEWRKFNFKFSDTDSYEDISRFYKEVENQAFSMSFTKIPTVYIDSLVDEGKLYLFKLHNKDFSEHSKGKPNLHTVYWNALFSEYNLQNTVYQLNGSAEIFFRKASIPENERVIHKKNVPITRKVAELNGKKEVSVFPYDIIKNRRYTVDKFQFHVPLKMNFKADEKKRINDDVIEAIRSNKGIHVIGIDRGERNLLYLSLINEEGRIIEQRSLNIIDSGEGHTQNYRDLLDSREKDREKARENWQEIQEIKDLKTGYLSQAIHTITKWMKEYNAIIVLEDLNDRFTNGRKKVEKQVYQKFEKMLIDKLNYYVDKDEEFDRMGGTHRALQLTEKFESFQKLGRQTGFIFYVPAWNTSKLDPTTGFVDLLYPKYKSVDATKDFIKKFDFIRFNSEKNYFEFGLHYSNFTERAIGCRDEWILCSYGNRIVNFRNAAKNNSWDYKEIDITKQLLDLFEKNGIDVKQENLIDSICEMKDKPFFKSLIANIKLILQIRNSASGTDIDYMISPAMNDRGEFFDTRKGLQQLPLDADANGAYNIAKKGLWIVDQIRNTTGNNVKMAMSNREWMHFAQESRLA

SEQ ID NO: 112 - protein, 1214 aa, Unknown
  source: /note="Description of Unknown: candidate division WS6 bacterium polypeptide"
MKNVFGGFTNLYSLTKTLRFELKPTSKTQKLMKRNNVIQTDEEIDKLYHDEMKPILDEIHRRFINDALAQKIFISASLDNFLKVVKNYKVESAKKNIKQNQVKLLQKEITIKTLGLRREVVSGFITVSKKWKDKYVGLGIKLKGDGYKVLTEQAVLDILKIEFPNKAKYIDKFRGFWTYFSGFNENRKNYYSEEDKATSIANRIVNENLSRYIDNIIAFEEILQKIPNLKKFKQDLDITSYNYYLNQAGIDKYNKIIGGYIVDKDKKIQGINEKVNLYTQQTKKKLPKLKFLFKQIGSERKGFGIFEIKEGKEWEQLGDLFKLQRTKINSNGREKGLFDSLRTMYREFFDEIKRDSNSQARYSLDKIYFNKASVNTISNSWFTNWNKFAELLNIKEDKKNGEKKIPEQISIEDIKDSLSIIPKENLEELFKLTNREKHDRTRFFGSNAWVTFLNIWQNEIEESFNKLEEKEKDFKKNAAIKFQKNNLVQKNYIKEVCDRMLAIERMAKYHLPKDSNLSREEDFYWIIDNLSEQREIYKYYNAFRNYISKKPYNKSKMKLNFENGNLLGGWSDGQERNKAGVILRNGNKYYLGVLINRGIFRTDKINNEIYRTGSSKWERLILSNLKFQTLAGKGFLGKHGVSYGNMNPEKSVPSLQKFIRENYLKKYPQLTEVSNTKFLSKKDFDAAIKEALKECFTMNFINIAENKLLEAEDKGDLYLFEITNKDFSGKKSGKDNIHTIYWKYLFSESNCKSPIIGLNGGAEIFFREGQKDKLHTKLDKKGKKVFDAKRYSEDKLFFHVSITINYGKPKNIKFRDIINQLITSMNVNIIGIDRGEKHLLYYSVIDSNGIILKQGSLNKIRVGDKEVDFNKKLTERANEMKKARQSWEQIGNIKNFKEGYLSQAIHEIYQLMIKYNAIIVLEDLNTEFKAKRLSKVEKSVYKKFELKLARKLNHLILKDRNTNEIGGVLKAYQLTPTIGGGDVSKFEKAKQWGMMFYVRANYTSTTDPVTGWRKHLYISNFSNNSVIKSFFDPTNRDTGIEIFYSGKYRSWGFRYVQKETGKKWELFATKELERFKYNQTTKLCEKINLYDKFEELFKGIDKSADIYSQLCNVLDFRWKSLVYLWNLLNQIRNVDKNAEGNKNDFIQSPVYPFFDSRKTDGKTEPINGDANGALNIARKGLMLVERIKNNPEKYEQLIRDTEWDAWIQNFNKVN

SEQ ID NO: 113 - protein, 1206 aa, Unknown
  source: /note="Description of Unknown: Lachnospiraceae bacterium polypeptide"
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGYLSQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 114 - protein, 1206 aa, Butyrivibrio sp.
MYYQNLTKKYPVSKTIRNELIPIGKTLENIRKNNILESDVKRKQDYEHVKGIMDEYHKQLINEALDNYMLPSLNQAAEIYLKKHVDVEDREEFKKTQDLLRREVTGRLKEHENYTKIGKKDILDLLEKLPSISEEDYNALESFRNFYTYFTSYNKVRENLYSDEEKSSTVAYRLINENLPKFLDNIKSYAFVKAAGVLADCIEEEEQDALFMVETFNMTLTQEGIDMYNYQIGKVNSAINLYNQKNHKVEEFKKIPKMKVLYKQILSDREEVFIGEFKDDETLLSSIGAYGNVLMTYLKSEKINIFFDALRESEGKNVYVKNDLSKTTMSNIVFGSWSAFDELLNQEYDLANENKKKDDKYFEKRQKELKKNKSYTLEQMSNLSKEDISPIENYIERISEDIEKICIYNGEFEKIVVNEHDSSRKLSKNIKAVKVIKDYLDSIKELEHDIKLINGSGQELEKNLVVYVGQEEALEQLRPVDSLYNLTRNYLTKKPFSTEKVKLNFNKSTLLNGWDKNKETDNLGILFFKDGKYYLGIMNTTANKAFVNPPAAKTENVFKKVDYKLLPGSNKMLPKVFFAKSNIGYYNPSTELYSNYKKGTHKKGPSFSIDDCHNLIDFFKESIKKHEDWSKFGFEFSDTADYRDISEFYREVEKQGYKLTFTDIDESYINDLIEKNELYLFQIYNKDFSEYSKGKLNLHTLYFMMLFDQRNLDNVVYKLNGEAEVFYRPASIAENELVIHKAGEGIKNKNPNRAKVKETSTFSYDIVKDKRYSKYKFTLHIPITMNFGVDEVRRFNDVINNALRTDDNVNVIGIDRGERNLLYVVVINSEGKILEQISLNSIINKEYDIETNYHALLDEREDDRNKARKDWNTIENIKELKTGYLSQVVNVVAKLVLKYNAIICLEDLNFGFKRGRQKVEKQVYQKFEKMLIEKLNYLVIDKSREQVSPEKMGGALNALQLTSKFKSFAELGKQSGIIYYVPAYLTSKIDPTTGFVNLFYIKYENIEKAKQFFDGFDFIRFNKKDDMFEFSFDYKSFTQKACGIRSKWIVYTNGERIIKYPNPEKNNLFDEKVINVTDEIKGLFKQYRIPYENGEDIKEIIISKAEADFYKRLFRLLHQTLQMRNSTSDGTRDYIISPVKNDRGEFFCSEFSEGTMPKDADANGAYNIARKGLWVLEQIRQKDEGEKVNLSMTNAEWLKYAQLHLL

SEQ ID NO: 115 - protein, 1205 aa, Oribacterium sp.
MYYDGLTKQYALSKTIRNELVPIGKTLDNIKKNRILEADIKRKSDYEHVKKLMDMYHKKIINEALDNFKLSVLEDAADIYFNKQNDERDIDAFLKIQDKLRKEIVEQLKGHTDYSKVGNKDFLGLLKAASTEEDRILIESFDNFYTYFTSYNKVRSNLYSAEDKSSTVAYRLINENLPKFFDNIKAYRTVRNAGVISGDMSIVEQDELFEVDTFNHTLTQYGIDTYNHMIGQLNSAINLYNQKMHGAGSFKKLPKMKELYKQLLTEREEEFIEEYTDDEVLITSVHNYVSYLIDYLNSDKVESFFDTLRKSDGKEVFIKNDVSKTTMSNILFDNWSTIDDLINHEYDSAPENVKKTKDDKYFEKRQKDLKKNKSYSLSKIAALCRDTTILEKYIRRLVDDIEKIYTSNNVFSDIVLSKHDRSKKLSKNTNAVQAIKNMLDSIKDFEHDVMLINGSGQEIKKNLNVYSEQEALAGILRQVDHIYNLTRNYLTKKPFSTEKIKLNFNRPTFLDGWDKNKEEANLGILLIKDNRYYLGIMNTSSNKAFVNPPKAISNDIYKKVDYKLLPGPNKMLPKVFFATKNIAYYAPSEELLSKYRKGTHKKGDSFSIDDCRNLIDFFKSSINKNTDWSTFGFNFSDTNSYNDISDFYREVEKQGYKLSFTDIDACYIKDLVDNNELYLFQIYNKDFSPYSKGKLNLHTLYFKMLFDQRNLDNVVYKLNGEAEVFYRPASIESDEQIIHKSGQNIKNKNQKRSNCKKTSTFDYDIVKDRRYCKDKFMLHLPITVNFGTNESGKFNELVNNAIRADKDVNVIGIDRGERNLLYVVVVDPCGKIIEQISLNTIVDKEYDIETDYHQLLDEKEGSRDKARKDWNTIENIKELKEGYLSQVVNIIAKLVLKYDAIICLEDLNFGFKRGRQKVEKQVYQKFEKMLIDKMNYLVLDKSRKQESPQKPGGALNALQLTSAFKSFKELGKQTGIIYYVPAYLTSKIDPTTGFANLFYIKYESVDKARDFFSKFDFIRYNQMDNYFEFGFDYKSFTERASGCKSKWIACTNGERIVKYRNSDKNNSFDDKTVILTDEYRSLFDKYLQNYIDEDDLKDQILQIDSADFYKNLIKLFQLTLQMRNSSSDGKRDYIISPVKNYREEFFCSEFSDDTFPRDADANGAYNIARKGLWVIKQIRETKSGTKINLAMSNSEWLEYAQCNLL

SEQ ID NO: 116 - protein, 1205 aa, Pseudobutyrivibrio ruminis
MYYQNLTKMYPISKTLRNELIPVGKTLENIRKNGILEADIQRKADYEHVKKLMDNYHKQLINEALQGVHLSDLSDAYDLYFNLSKEKNSVDAFSKCQDKLRKEIVSLLKNHENFPKIGNKEIIKLLQSLYDNDTDYKALDSFSNFYTYFSSYNEVRKNLYSDEEKSSTVAYRLINENLPKFLDNIKAYAIAKKAGVRAEGLSEEDQDCLFIIETFERTLTQDGIDNYNAAIGKLNTAINLFNQQNKKQEGFRKVPQMKCLYKQILSDREEAFIDEFSDDEDLITNIESFAENMNVFLNSEIITDFKIALVESDGSLVYIKNDVSKTSFSNIVFGSWNAIDEKLSDEYDLANSKKKKDEKYYEKRQKELKKNKSYDLETIIGLFDDNSDVIGKYIEKLESDITAIAEAKNDFDEIVLRKHDKNKSLRKNTNAVEAIKSYLDTVKDFERDIKLINGSGQEVEKNLVVYAEQENILAEIKNVDSLYNMSRNYLTQKPFSTEKFKLNFNRATLLNGWDKNKETDNLGILFEKDGMYYLGIMNTKANKIFVNIPKATSNDVYHKVNYKLLPGPNKMLPKVFFAQSNLDYYKPSEELLAKYKAGTHKKGDNFSLEDCHALIDFFKASIEKHPDWSSFGFEFSETCTYEDLSGFYREVEKQGYKITYTDVDADYITSLVERDELYLFQIYNKDFSPYSKGNLNLHTIYLQMLFDQRNLNNVVYKLNGEAEVFYRPASINDEEVIIHKAGEEIKNKNSKRAVDKPTSKFGYDIIKDRRYSKDKFMLHIPVTMNFGVDETRRFNDVVNDALRNDEKVRVIGIDRGERNLLYVVVVDTDGTILEQISLNSIINNEYSIETDYHKLLDEKEGDRDRARKNWTTIENIKELKEGYLSQVVNVIAKLVLKYNAIICLEDLNFGFKRGRQKVEKQVYQKFEKMLIDKLNYLVIDKSRKQDKPEEFGGALNALQLTSKFTSFKDMGKQTGIIYYVPAYLTSKIDPTTGFANLFYVKYENVEKAKEFFSRFDSISYNNESGYFEFAFDYKKFTDRACGARSQWTVCTYGERIIKFRNTEKNNSFDDKTIVLSEEFKELFSIYGISYEDGAELKNKIMSVDEADFFRSLTRLFQQTMQMRNSSNDVTRDYIISPIMNDRGEFFNSEACDASKPKDADANGAFNIARKGLWVLEQIRNTPSGDKLNLAMSNAEWLEYAQRNQI

SEQ ID NO: 117 - protein, 1154 aa, Proteocatella sphenisci
MENFKNLYPINKTLRFELRPYGKTLENFKKSGLLEKDAFKANSRRSMQAIIDEKFKETIEERLKYTEFSECDLGNMTSKDKKITDKAATNLKKQVILSFDDEIFNNYLKPDKNIDALFKNDPSNPVISTFKGFTTYFVNFFEIRKHIFKGESSGSMAYRIIDENLTTYLNNIEKIKKLPEELKSQLEGIDQIDKLNNYNEFITQSGITHYNEIIGGISKSENVKIQGINEGINLYCQKNKVKLPRLTPLYKMILSDRVSNSFVLDTIENDTELIEMISDLINKTEISQDVIMSDIQNIFIKYKQLGNLPGISYSSIVNAICSDYDNNFGDGKRKKSYENDRKKHLETNVYSINYISELLTDTDVSSNIKMRYKELEQNYQVCKENFNATNWMNIKNIKQSEKTNLIKDLLDILKSIQRFYDLFDIVDEDKNPSAEFYTWLSKNAEKLDFEFNSVYNKSRNYLTRKQYSDKKIKLNFDSPTLAKGWDANKEIDNSTIIMRKFNNDRGDYDYFLGIWNKSTPANEKIIPLEDNGLFEKMQYKLYPDPSKMLPKQFLSKIWKAKHPTTPEFDKKYKEGRHKKGPDFEKEFLHELIDCFKHGLVNHDEKYQDVFGFNLRNTEDYNSYTEFLEDVERCNYNLSFNKIADTSNLINDGKLYVFQIWSKDFSIDSKGTKNLNTIYFESLFSEENMIEKMFKLSGEAEIFYRPASLNYCEDIIKKGHHHAELKDKFDYPIIKDKRYSQDKFFFHVPMVINYKSEKLNSKSLNNRTNENLGQFTHIIGIDRGERHLIYLTVVDVSTGEIVEQKHLDEIINTDTKGVEHKTHYLNKLEEKSKTRDNERKSWEAIETIKELKEGYISHVINEIQKLQEKYNALIVMENLNYGFKNSRIKVEKQVYQKFETALIKKFNYIIDKKDPETYIHGYQLTNPITTLDKIGNQSGIVLYIPAWNTSKIDPVTGFVNLLYADDLKYKNQEQAKSFIQKIDNIYFENGEFKFDIDFSKWNNRYSISKTKWTLTSYGTRIQTFRNPQKNNKWDSAEYDLTEEFKLILNIDGTLKSQDVETYKKFMSLFKLMLQLRNSVTGTDIDYMISPVTDKTGTHFDSRENIKNLPADADANGAYNIARKGIMAIENIMNGISDPLKISNEDYLKYIQNQQE

SEQ ID NO: 118 - DNA, 100 bp, Artificial Sequence
  source: /note="Description of Artificial Sequence: Synthetic polynucleotide"
cttgtggaaaggacgaaacaccgggccaacatgaggatcacccatgtctgcagggccagtaatttctactaagtgtagatttcttcatccctagccagcc

SEQ ID NO: 119 - DNA, 34 bp, Artificial Sequence
  source: /note="Description of Artificial Sequence: Synthetic oligonucleotide"
ttagagaagtcatttaataaggccactgttaaaa

SEQ ID NO: 120 - DNA, 34 bp, Artificial Sequence
  source: /note="Description of Artificial Sequence: Synthetic oligonucleotide"
  source: /note="Description of Combined DNA/RNA Molecule: Synthetic oligonucleotide"
ttcgagaagucauuuaauaaggccacuguuaaaa

SEQ ID NO: 121 - DNA, 34 bp, Artificial Sequence; identical to SEQ ID NO: 120
  source: /note="Description of Artificial Sequence: Synthetic oligonucleotide"
  source: /note="Description of Combined DNA/RNA Molecule: Synthetic oligonucleotide"

SEQ ID NO: 122 - DNA, 34 bp, Artificial Sequence; identical to SEQ ID NO: 120
  source: /note="Description of Artificial Sequence: Synthetic oligonucleotide"
  source: /note="Description of Combined DNA/RNA Molecule: Synthetic oligonucleotide"

SEQ ID NO: 123 - DNA, 34 bp, Artificial Sequence; identical to SEQ ID NO: 120
  source: /note="Description of Artificial Sequence: Synthetic oligonucleotide"
  source: /note="Description of Combined DNA/RNA Molecule: Synthetic oligonucleotide"

SEQ ID NO: 124 - DNA, 24 bp, Artificial Sequence
  source: /note="Description of Artificial Sequence: Synthetic oligonucleotide"
ctgatggtccatgtctgttactcg

SEQ ID NO: 125 - DNA, 20 bp, Artificial Sequence
  source: /note="Description of Artificial Sequence: Synthetic primer"
ctgggactcaggcgggtcac

SEQ ID NO: 126 - DNA, 25 bp, Artificial Sequence
  source: /note="Description of Artificial Sequence: Synthetic primer"
cctcacacaacagcttcatgtcagc

SEQ ID NO: 127 - DNA, 3960 bp, Artificial Sequence
  source: /note="Description of Artificial Sequence: Synthetic polynucleotide"
atggccccaaagaagaagcggaaggtcggtatccacggagtcccagcagccggtagtaacatcaaaaactttaccgggctctaccccctcagcaaaactttgcgctttgaactcaagcctattggcaaaaccaaggaaaacatcgagaaaaatggcatcctgaccaaggacgagcaacgggctaaagactacctcatagtcaaaggctttattgacgagtatcacaagcagttcatcaaagacaggctttgggactttaaattgcctctcgaaagtgagggggagaagaacagtctcgaagaataccaggaactgtacgagctcactaagcgcaacgatgcccaggaggccgacttcaccgagattaaagataaccttcgcagctctattaccgaacagctcacgaagtctggatctgcgtacgatcggatttttaaaaaagagttcattagagaagacctggtcaacttcctcgaagatgaaaaagataaaaatatcgtgaaacagttcgaggactttactacatattttacgggtttttatgaaaataggaagaacatgtactctagcgaagagaagtccacggccatcgcataccggcttatccatcagaatctgccaaaattcatggacaacatgagaagttttgccaaaattgcaaattccagtgtttccgagcactttagcgacatctatgaaagctggaaggaatatctgaatgtaaatagcatcgaggaaatcttccagctcgactattttagcgaaaccttgactcagccacatattgaggtgtataactatattatcgggaagaaagtcctggaagacggaaccgagataaagggcatcaacgagtatgtgaacctctacaatcagcagcagaaagataagagtaaacgactgcctttcctggtgccactgtataagcaaattttgtctgatagggaaaaactctcctggattgctgaagagttcgacagcgacaagaagatgctgagcgctatcaccgagtcttacaaccacctgcacaacgtgttgatgggtaacgagaacgaaagcctgcgaaatctgctgctgaatattaaggactataacctggagaaaattaatatcacaaacgacttgtctctcaccgaaatctcccagaatctttttggccgatatgatgtattcacaaatgggatcaaaaacaagctgagagtgttgactccaaggaagaaaaaggagacggacgaaaattttgaggaccgcattaacaaaatttttaagacccagaagtccttcagcatcgcttttctgaacaagctgcctcagcccgaaatggaggatgggaagccccggaacattgaggactatttcattacacagggggcgattaacaccaaatctatacagaaagaagatatcttcgcccaaattgagaatgcatacgaggatgcacaggtgttcctgcaaattaaggacaccgacaacaaacttagccagaacaagacggcggtggaaaagatcaaaactttgctggacgccttgaaggaactccagcacttcatcaaaccgctgctgggctctggggaggagaacgagaaagacgaactgttctacggttccttcctggccatctgggacgaactggacaccattacaccactttataacaaagtgagaaattggctgacccgaaaaccatattcaacagaaaaaatcaaattgaatttcgacaacgctcagctgctgggagggtgggatgtcaataaagaacacgactgtgcaggtatcttgttgcggaaaaacgatagctactatctcggaattatcaataagaaaaccaaccacatctttgatacggatattacgccatcagatggcgagtgctatgacaaaatcgactacaagctccttcccggggcgaacaaaatgcttccaaaggtgttttttagtaagtcccgaatcaaagagttcgagccatcagaggccataatcaattgctataagaaggggacacacaaaaaaggaaaaaactttaacctgacggactgtcaccgcctgatcaacttttttaagacctcaatcgagaaacacgaggattggtcaaaattcggattcaagttctccgataccgaaacgtatgaggatattagcggtttttatagagaggtcgagcagcagggatacaggctgacgagccatccagtcagtgccagctatatacatagtctggtcaaggaaggaaaactgtacctcttccaaatctggaacaaggacttttctcaattctccaaggggacccctaacttgcacactctctattggaagatgctgtttgacaaacggaatcttagcgatgtggtttataagctgaatggccaggctgaagtgttctatagaaagagctccattgaacaccagaaccgaattatccaccccgctcagcatcccatcacaaataagaatgagcttaacaaaaagcacactagcaccttcaaatacgatatcatcaaagatcgcagatacacggtggataaattccagttccatgtgcccattactataaattttaaggcgaccgggcagaacaacatcaacccaatcgtccaagaggtgattcgccaaaacggtatcacccacatcataggcatcgatcgaggtgaacgccatcttctgtacctctctctcatcgatttgaaaggcaacatcatcaagcagatgactctcaacgaaattattaatgagtataagggtgtgacctataagaccaactaccataacctcctggagaagagggagaaggagcggaccgaggccagacactcctggagtagtattgaaagcataaaagaactgaaggatggatacatgtcacaggtgattcacaaaattacggacatgatggttaagtacaatgcgattgtggtcctggaggacctcaacggggggtttatgcgaggccgccagaaggtcgagaagcaggtgtaccagaaatttgaaaaaaagttgatcgacaagctgaactatctcgttgacaagaaactcgacgctaacgaggtcggcggagtactgaatgcttatcagctgaccaacaagttcgagtctttcaagaagattgggaaacaaagcggatttttgttctacatccccgcctggaacacaagcaaaatcgatcctataacagggttcgttaatctgttcaacaccaggtacgagtctatcaaggagacaaaagttttttggtctaagtttgatattatccgatacaataaagagaagaattggttcgagttcgtcttcgattacaatacctttacgactaaagcggagggaacacgcactaagtggactctgtgcacccacggcactcgcatccagacattccggaacccagaaaagaatgcccagtgggacaataaagagatcaatttgactgagtccttcaaagctctgtttgaaaagtacaagatcgatatcaccagtaatctcaaggaatccatcatgcaggaaaccgagaagaagttcttccaggaactgcataatctgctccacctgaccctgcagatgaggaatagcgttactggaaccgacatagactatttgatcagccccgttgccgatgaggatggaaatttctatgatagtcgcataaatggcaaaaattttccggagaatgccgatgccaatggcgcgtacaacatcgcacgaaagggtctgatgcttattcggcagatcaagcaagcagatccacagaagaaattcaagtttgagacaatcaccaataaagactggctgaaattcgcccaagacaagccctatcttaaagatggcagcgggaaaaggccggcggccacgaaaaaggccggccaggcaaaaaagaaaaagggatcctacccatacgatgttccagattacgcttatccctacgacgtgcctgattatgcatacccatacgatgtccccgactatgcctaa

SEQ ID NO: 128 - DNA, 23 bp, Artificial Sequence
  source: /note="Description of Artificial Sequence: Synthetic oligonucleotide"
cctcactcctgctcggtgaattt

SEQ ID NO: 129 - DNA, 23 bp, Artificial Sequence
  source: /note="Description of Artificial Sequence: Synthetic oligonucleotide"
ctgatggtccatgtctgttactc

SEQ ID NO: 130 - protein, 6 aa, Artificial Sequence
  source: /note="Description of Artificial Sequence: Synthetic 6xHis tag"
HHHHHH

SEQ ID NO: 131 - DNA, 31 bp, Francisella novicida
gagaagtcatttaataaggccactgttaaaa

SEQ ID NO: 132 - DNA, 30 bp, Francisella novicida
gctactattcctgtgccttcagataattca

SEQ ID NO: 133 - DNA, 27 bp, Francisella novicida
gtctagagccttttgtattagtagccg

SEQ ID NO: 134 - DNA, 98 bp, Artificial Sequence
  source: /note="Description of Artificial Sequence: Synthetic oligonucleotide"
  modified_base (30)..(37): a, c, t, g, unknown or other
ggccagtgaattcgagctcggtacccgggnnnnnnnngagaagtcatttaataaggccactgttaaaaagcttggcgtaatcatggtcatagctgttt

SEQ ID NO: 135 - DNA, 98 bp, Artificial Sequence
  source: /note="Description of Artificial Sequence: Synthetic oligonucleotide"
  modified_base (61)..(68): a, c, t, g, unknown or other
ggccagtgaattcgagctcggtacccggggagaagtcatttaataaggccactgttaaaannnnnnnnagcttggcgtaatcatggtcatagctgttt

SEQ ID NO: 136 - DNA, 25 bp, Artificial Sequence
  source: /note="Description of Artificial Sequence: Synthetic oligonucleotide"
gctgacatgaagctgttgtgtgagg

SEQ ID NO: 137 - DNA, 21 bp, Artificial Sequence
  source: /note="Description of Artificial Sequence: Synthetic primer"
ggccagtgaattcgagctcgg

SEQ ID NO: 138 - DNA, 28 bp, Artificial Sequence
  source: /note="Description of Artificial Sequence: Synthetic primer"
caatttcacacaggaaacagctatgacc

SEQ ID NO: 139 - DNA, 21 bp, Artificial Sequence
  source: /note="Description of Artificial Sequence: Synthetic primer"
cggggctggcttaactatgcg

SEQ ID NO: 140 - DNA, 20 bp, Artificial Sequence
  source: /note="Description of Artificial Sequence: Synthetic primer"
gcccaatacgcaaaccgcct

SEQ ID NO: 141 - DNA, 20 bp, Artificial Sequence
  source: /note="Description of Artificial Sequence: Synthetic primer"
ccatccccttctgtgaatgt

SEQ ID NO: 142 - DNA, 20 bp, Artificial Sequence
  source: /note="Description of Artificial Sequence: Synthetic primer"
tctccgtgtctccaatctcc

SEQ ID NO: 143 - DNA, 20 bp, Artificial Sequence
  source: /note="Description of Artificial Sequence: Synthetic primer"
ctgggactcaggcgggtcac

SEQ ID NO: 144 - DNA, 25 bp, Artificial Sequence
  source: /note="Description of Artificial Sequence: Synthetic primer"
gctgacatgaagctgttgtgtgagg

SEQ ID NO: 145 - DNA, 24 bp, Artificial Sequence
  source: /note="Description of Artificial Sequence: Synthetic oligonucleotide"
gagaagtcatttaataaggccact

SEQ ID NO: 146 - DNA, 22 bp, Artificial Sequence
  source: /note="Description of Artificial Sequence: Synthetic oligonucleotide"
gagaagtcatttaataaggcca

SEQ ID NO: 147 - DNA, 20 bp, Artificial Sequence
  source: /note="Description of Artificial Sequence: Synthetic oligonucleotide"
gagaagtcatttaataaggc

SEQ ID NO: 148 - DNA, 18 bp, Artificial Sequence
  source: /note="Description of Artificial Sequence: Synthetic oligonucleotide"
gagaagtcatttaataag

SEQ ID NO: 149 - DNA, 17 bp, Artificial Sequence
  source: /note="Description of Artificial Sequence: Synthetic oligonucleotide"
gagaagtcatttaataa

SEQ ID NO: 150 - DNA, 16 bp, Artificial Sequence
  source: /note="Description of Artificial Sequence: Synthetic oligonucleotide"
gagaagtcatttaata

SEQ ID NO: 151 - DNA, 24 bp, Artificial Sequence
  source: /note="Description of Artificial Sequence: Synthetic oligonucleotide"
gataagtcatttaataaggccact

SEQ ID NO: 152 - DNA, 24 bp, Artificial Sequence
  source: /note="Description of Artificial Sequence: Synthetic oligonucleotide"
gagaaggcatttaataaggccact

SEQ ID NO: 153 - DNA, 24 bp, Artificial Sequence
  source: /note="Description of Artificial Sequence: Synthetic oligonucleotide"
gagaagtcatgtaataaggccact

SEQ ID NO: 154 - DNA, 24 bp, Artificial Sequence
  source: /note="Description of Artificial Sequence: Synthetic oligonucleotide"
gagaagtcatttaagaaggccact

SEQ ID NO: 155 - DNA, 24 bp, Artificial Sequence
  source: /note="Description of Artificial Sequence: Synthetic oligonucleotide"
gagaagtcatttaataagtccact

SEQ ID NO: 156 - DNA, 24 bp, Artificial Sequence
  source: /note="Description of Artificial Sequence: Synthetic oligonucleotide"
gagaagtcatttaataaggccaat

SEQ ID NO: 157 - DNA, 42 bp, Artificial Sequence
  source: /note="Description of Artificial Sequence: Synthetic oligonucleotide"
atttctactgttgtagatgagaagtcatttaataaggccact

SEQ ID NO: 158 - DNA, 41 bp, Artificial Sequence
  source: /note="Description of Artificial Sequence: Synthetic oligonucleotide"
tttctactgttgtagatgagaagtcatttaataaggccact

SEQ ID NO: 159 - DNA, 40 bp, Artificial Sequence
  source: /note="Description of Artificial Sequence: Synthetic oligonucleotide"
ttctactgttgtagatgagaagtcatttaataaggccact

SEQ ID NO: 160 - DNA, 39 bp, Artificial Sequence
  source: /note="Description of Artificial Sequence: Synthetic oligonucleotide"
tctactgttgtagatgagaagtcatttaataaggccact

SEQ ID NO: 161 - DNA, 35 bp, Artificial Sequence
  source: /note="Description of Artificial Sequence: Synthetic oligonucleotide"
ctgttgtagatgagaagtcatttaataaggccact

SEQ ID NO: 162 - DNA, 31 bp, Artificial Sequence
  source: /note="Description of Artificial Sequence: Synthetic oligonucleotide"
tgtagatgagaagtcatttaataaggccact

SEQ ID NO: 163 - DNA, 19 bp, Artificial Sequence
  source: /note="Description of Artificial Sequence: Synthetic oligonucleotide"
aatttctgctgttgcagat

SEQ ID NO: 164 - DNA, 19 bp, Artificial Sequence
  source: /note="Description of Artificial Sequence: Synthetic oligonucleotide"
aatttccactgttgtggat

SEQ ID NO: 165 - DNA, 19 bp, Artificial Sequence
  source: /note="Description of Artificial Sequence: Synthetic oligonucleotide"
aattcctactgttgtaggt

SEQ ID NO: 166 - DNA, 19 bp, Artificial Sequence
  source: /note="Description of Artificial Sequence: Synthetic oligonucleotide"
aatttatactgttgtagat

SEQ ID NO: 167 - DNA, 19 bp, Artificial Sequence
  source: /note="Description of Artificial Sequence: Synthetic oligonucleotide"
aatttcgactgttgtagat

SEQ ID NO: 168 - DNA, 19 bp, Artificial Sequence
  source: /note="Description of Artificial Sequence: Synthetic oligonucleotide"
aatttctagtgttgtagat

SEQ ID NO: 169 - DNA, 19 bp, Artificial Sequence
  source: /note="Description of Artificial Sequence: Synthetic oligonucleotide"
aatttctactattgtagat

SEQ ID NO: 170 - DNA, 19 bp, Artificial Sequence
  source: /note="Description of Artificial Sequence: Synthetic oligonucleotide"
aatttctactgctgtagat

SEQ ID NO: 171 - DNA, 18 bp, Artificial Sequence
  source: /note="Description of Artificial Sequence: Synthetic oligonucleotide"
aatttctactttgtagat

SEQ ID NO: 172 - DNA, 17 bp, Artificial Sequence
  source: /note="Description of Artificial Sequence: Synthetic oligonucleotide"
aatttctacttgtagat

SEQ ID NO: 173 - DNA, 19 bp, Artificial Sequence
  source: /note="Description of Artificial Sequence: Synthetic oligonucleotide"
aatttctacttttgtagaa

SEQ ID NO: 174 - DNA, 19 bp, Artificial Sequence
  source: /note="Description of Artificial Sequence: Synthetic oligonucleotide"
aatttctacttttgtagac

SEQ ID NO: 175 - DNA, 20 bp, Artificial Sequence
  source: /note="Description of Artificial Sequence: Synthetic oligonucleotide"
taatttctactgttgtagat

SEQ ID NO: 176 - DNA, 23 bp, Artificial Sequence
  source: /note="Description of Artificial Sequence: Synthetic oligonucleotide"
cctcactcctgctcggtgaattt

SEQ ID NO: 177 - DNA, 20 bp, Artificial Sequence
  source: /note="Description of Artificial Sequence: Synthetic oligonucleotide"
taatttctactgttgtagat

SEQ ID NO: 178 - DNA, 23 bp, Artificial Sequence
  source: /note="Description of Artificial Sequence: Synthetic oligonucleotide"
aggagtgttcagtctccgtgaac

SEQ ID NO: 179 - DNA, 20 bp, Artificial Sequence
  source: /note="Description of Artificial Sequence: Synthetic oligonucleotide"
taatttctactgttgtagat

SEQ ID NO: 180 - DNA, 23 bp, Artificial Sequence
  source: /note="Description of Artificial Sequence: Synthetic oligonucleotide"
ctgatggtccatgtctgttactc

SEQ ID NO: 181 - DNA, 20 bp, Artificial Sequence
  source: /note="Description of Artificial Sequence: Synthetic oligonucleotide"
taatttctactgttgtagat

SEQ ID NO: 182 - DNA, 23 bp, Artificial Sequence
  source: /note="Description of Artificial Sequence: Synthetic oligonucleotide"
tttcccttcagctaaaataaagg

SEQ ID NO: 183 - DNA, 21 bp, Artificial Sequence
  source: /note="Description of Artificial Sequence: Synthetic oligonucleotide"
taatttctactaagtgtagat

SEQ ID NO: 184 - DNA, 23 bp, Artificial Sequence
  source: /note="Description of Artificial Sequence: Synthetic oligonucleotide"
cctcactcctgctcggtgaattt

SEQ ID NO: 185 - DNA, 21 bp, Artificial Sequence
  source: /note="Description of Artificial Sequence: Synthetic oligonucleotide"
taatttctactaagtgtagat

SEQ ID NO: 186 - DNA, 23 bp, Artificial Sequence
  source: /note="Description of Artificial Sequence: Synthetic oligonucleotide"
aggagtgttcagtctccgtgaac

SEQ ID NO: 187 - DNA, 21 bp, Artificial Sequence
  source: /note="Description of Artificial Sequence: Synthetic oligonucleotide"
taatttctactaagtgtagat

SEQ ID NO: 188 - DNA, 23 bp, Artificial Sequence
  source: /note="Description of Artificial Sequence: Synthetic oligonucleotide"
ctgatggtccatgtctgttactc

SEQ ID NO: 189 - DNA, 21 bp, Artificial Sequence
  source: /note="Description of Artificial Sequence: Synthetic oligonucleotide"
taatttctactaagtgtagat

SEQ ID NO: 190 - DNA, 23 bp, Artificial Sequence
  source: /note="Description of Artificial Sequence: Synthetic oligonucleotide"
tttcccttcagctaaaataaagg

SEQ ID NO: 191 - DNA, 20 bp, Artificial Sequence
  source: /note="Description of Artificial Sequence: Synthetic oligonucleotide"
tcactcctgctcggtgaatt

SEQ ID NO: 192 - DNA, 20 bp, Artificial Sequence
  source: /note="Description of Artificial Sequence: Synthetic oligonucleotide"
aaccctctggggaccgtttg

SEQ ID NO: 193 - DNA, 20 bp, Artificial Sequence
  source: /note="Description of Artificial Sequence: Synthetic oligonucleotide"
agtacgttaatgtttcctga

SEQ ID NO: 194 - DNA, 100 bp, Artificial Sequence
  source: /note="Description of Artificial Sequence: Synthetic polynucleotide"
cttgtggaaaggacgaaacaccgtaatttctactggccaacatgaggatcacccatgtctgcagggccagaagtgtagatttcttcatccctagccagcc

SEQ ID NO: 195 - DNA, 20 bp, Artificial Sequence
  source: /note="Description of Artificial Sequence: Synthetic oligonucleotide"
taatttctactgttgtagat

SEQ ID NO: 196 - DNA, 21 bp, Artificial Sequence
  source: /note="Description of Artificial Sequence: Synthetic oligonucleotide"
agaaatgcatggttctcatgc

SEQ ID NO: 197 - DNA, 21 bp, Artificial Sequence
  source: /note="Description of Artificial Sequence: Synthetic oligonucleotide"
aaaattacctagtaattaggt

SEQ ID NO: 198 - DNA, 20 bp, Artificial Sequence
  source: /note="Description of Artificial Sequence: Synthetic oligonucleotide"
ggatttctacttttgtagat

SEQ ID NO: 199 - DNA, 20 bp, Artificial Sequence
  source: /note="Description of Artificial Sequence: Synthetic oligonucleotide"
aaatttctacttttgtagat

SEQ ID NO: 200 - DNA, 21 bp, Artificial Sequence
  source: /note="Description of Artificial Sequence: Synthetic oligonucleotide"
cgcgcccacgcggggcgcgac

SEQ ID NO: 201 - DNA, 20 bp, Artificial Sequence
  source: /note="Description of Artificial Sequence: Synthetic oligonucleotide"
taatttctactcttgtagat

SEQ ID NO: 202 - DNA, 20 bp, Artificial Sequence
  source: /note="Description of Artificial Sequence: Synthetic oligonucleotide"
gaatttctactattgtagat

SEQ ID NO: 203 - DNA, 21 bp, Artificial Sequence
  source: /note="Description of Artificial Sequence: Synthetic oligonucleotide"
gaatctctactctttgtagat

SEQ ID NO: 204 - DNA, 19 bp, Artificial Sequence
  source: /note="Description of Artificial Sequence: Synthetic oligonucleotide"
taatttctactttgtagat

SEQ ID NO: 205 - DNA, 21 bp, Artificial Sequence
  source: /note="Description of Artificial Sequence: Synthetic oligonucleotide"
aaatttctactgtttgtagat

SEQ ID NO: 206 - DNA, 20 bp, Artificial Sequence
  source: /note="Description of Artificial Sequence: Synthetic oligonucleotide"
gaatttctacttttgtagat

SEQ ID NO: 207 - DNA, 21 bp, Artificial Sequence
  source: /note="Description of Artificial Sequence: Synthetic oligonucleotide"
taatttctactaagtgtagat

SEQ ID NO: 208 - DNA, 20 bp, Artificial Sequence
  source: /note="Description of Artificial Sequence: Synthetic oligonucleotide"
taatttctactattgtagat

SEQ ID NO: 209 - DNA, 20 bp, Artificial Sequence
  source: /note="Description of Artificial Sequence: Synthetic oligonucleotide"
taatttctacttcggtagat

SEQ ID NO: 210 - DNA, 20 bp, Artificial Sequence
  source: /note="Description of Artificial Sequence: Synthetic oligonucleotide"
taatttctactattgtagat

SEQ ID NO: 211 - DNA, 6569 bp, Artificial Sequence
  source: /note="Description of Artificial Sequence: Synthetic polynucleotide"
catcaaggaattggttctaagcttatagaagcaatgattaaggaagccaaaaaaaataatattgatgcaatatttgtcttaggtcatccaagttattatccaaaatttggttttaaaccagccacagaatatcagataaaatgtgaatatgatgtcccagcggatgtttttatggtactagatttgtcagctaaactagctagtttaaaaggacaaactgtctactatgccgatgagtttggcaaaattttttagatctacaaaattataaactaaataaagattcttataataactttatatataatcgaaatgtagagaattttataaggagtctttatcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataactaattcattcaagaatatattaccctgtcagtttagcgactattacctctttaataatttgcaggggaattattttagtaatagtaatatacacaagagttattgattatatggaaaattatatttagataacatggttaaatgattttatattctgtccttactcgatatatttgcataatatctatagtaatgcctcagatactacatactattcatctagccaaacaaaagggcgcgatgctcataaaagtatcgataaaggaatctatagtaccaaaaaagatgacctgatcggtatcgatgttattaaccataaatatggtttggttggtaaaattgatgtttttcataaagataagggcttacttgtggagagaaaaaggcaaatcaagactatctatgatggctataaatatcagctttatgcgcaatatttttgtctccaagagatgggctatgatgtcaaagccattaaattttattcgatggttgataataaatcatacccaatagctataccaacttcagctgagttagaaaagtttgaaaaacatattcaaacaatcaagcaatataatccaatggataactcatttaggcaaaatattgaaaagtgtaaattttgtatatatgcaaacttatgtgataaaacggacttgtagattatgtttagtaaaaatgatattgaatcaaagaatatagtttttgttaatatttttgatggagtgaaacttagtctatcattggggaatatagttataaaagataaagaaactgatgaggtgaaaactaagctttctgttcataaagttcttgcattgtttatcgtaggtaatatgacgatgacctcgcaacttttagagacctgtaagaaaaatgctatacagctagtttttatgaaaaatagctttagaccatatctatgttttggtgatattgctgaggctaattttttagctagatataagcaatatagtgtagttgagcaagatataagtttagcaaggatttttataacatcaaagatacgcaatcaacataacttagtcaaaagcctaagagataaaactccagagcagcaagagatagtcaaaaagaataaacagctaatagcagagttagaaaatacaacaagcctagcggagctaatgggtatagagggcaatgttgccaaaaatttcttcaaaggattctatggacatttagatagttggcaagggcgcaaacctagaataaaacaggatccatataatgttgttttagacttgggctatagtatgttgtttaattttgtagagtgttttttgcgactttttggctttgatttatacaagggcttttgtcatcagacttggtataagcgtaaatccctagtttgtgactttgttgagccatttagatgtatagtggataaccaagttagaaaatcatggaatctcgggcaattttctgtagaggattttggttgcaaaaatgagcagttttatataaaaaaagataaaacaaaagactactcaaaaatactttttgccgagattatcagctacaagctagagatatttgaatatgtaagagaattttatcgtgcctttatgcgaggcaaagaaattgcagagtatccaatattttgttatgaaactaggagggtgtatgttgatagtcagttatgattttagtaataataaagtacgtgcaaagtttgccaaatttctagaaagttatggtgtacgtttacaatattcggtatttgagctcaaatatagcaagagaatgttagacttgattttagctgagatagaaaataactatgtaccactatttacaaatgctgatagtgttttaatctttaatgctccagataaagatgtgataaaatatggttatgcgattcatagagaacaagaggttgtttttatagactaaaaattgcaaaccttagtctttatgttaaaataactactaagttcttagagatatttaaaaatatgactgttgttatatatcaaaatgctaaaaaaatcatagattttaggtctttttttgctgatttaggcaaaaacgggtctaagaactttaaataatttctactgttgtagatgagaagtcatttaataaggccactgttaaaagtctaagaactttaaataatttctactgttgtagatgctactattcctgtgccttcagataattcagtctaagaactttaaataatttctactgttgtagatgtctagagccttttgtattagtagccggtctaagaactttaaataatttctactgttgtagattagcgatttatgaaggtcatttttttgtct

SEQ ID NO: 212 - DNA, 4170 bp, Artificial Sequence
  source: /note="Description of Artificial Sequence: Synthetic polynucleotide"
tttacactttatgcttccggctcgtatgttaggaggtctttatcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataactaattgacagctagctcagtcctaggtataatgctagcgctgatttaggcaaaaacgggtctaagaactttaaataatttctactgttgtagatgagaagtcatttaataaggccactgttaaaagtctaagaactttaaataatttctactgttgtagatgctactattcctgtgccttcagataattcagtctaagaactttaaataatttctactgttgtaga

SEQ ID NO: 213 - DNA, 4613 bp, Artificial Sequence
  source: /note="Description of Artificial Sequence: Synthetic polynucleotide"
ctgtctactatgccgatgagtttggcaaaattttttagatctacaaaattataaactaaataaagattcttataataactttatatataatcgaaatgtagagaattttataaggagtctttatcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataactaattcattcaagaatatattaccctgtcagtttagcgactattacctctttaataatttgcaggggaattattttagtaatagtaatatacacaagagttattgattatatggaaaattatatttagataacatggttaaatgattttatattctgtccttactcgatatattttttatagactaaaaattgcaaaccttagtctttatgttaaaataactactaagttcttagagatatttaaaaatatgactgttgttatatatcaaaatgctaaaaaaatcatagattttaggtctttttttgctgatttaggcaaaaacgggtctaagaactttaaataatttctactgttgtagatgagaagtcatttaataaggccactgttaaaagtctaagaactttaaataatttctactgttgtagatgctactattcctgtgccttcagataattcagtctaagaactttaaataatttctactgttgtagatgtctagagccttttgtattagtagccggtctaagaactttaaataatttctactgttgtagattagcgatttatgaaggtcatttttttgtct

SEQ ID NO: 214 - DNA, 4035 bp, Artificial Sequence
  source: /note="Description of Artificial Sequence: Synthetic polynucleotide"
atgagcatctaccaggagttcgtcaacaagtattcactgagtaagacactgcggttcgagctgatcccacagggcaagacactggagaacatcaaggcccgaggcctgattctggacgatgagaagcgggcaaaagactataagaaagccaagcagatcattgataaataccaccagttctttatcgaggaaattctgagctccgtgtgcatcagtgaggatctgctgcagaattactcagacgtgtacttcaagctgaagaagagcgacgatgacaacctgcagaaggacttcaagtccgccaaggacaccatcaagaaacagattagcgagtacatcaaggactccgaaaagtttaaaaatctgttcaaccagaatctgatcgatgctaagaaaggccaggagtccgacctgatcctgtggctgaaacagtctaaggacaatgggattgaactgttcaaggctaactccgatatcactgatattgacgaggcactggaaatcatcaagagcttcaagggatggaccacatactttaaaggcttccacgagaaccgcaagaacgtgtactccagcaacgacattcctacctccatcatctaccgaatcgtcgatgacaatctgccaaagttcctggagaacaaggccaaatatgaatctctgaaggacaaagctcccgaggcaattaattacgaacagatcaagaaagatctggctgaggaactgacattcgatatcgactataagactagcgaggtgaaccagagggtcttttccctggacgaggtgtttgaaatcgccaatttcaacaattacctgaaccagtccggcattactaaattcaataccatcattggcgggaagtttgtgaacggggagaataccaagcgcaagggaattaacgaatacatcaatctgtatagccagcagatcaacgacaaaactctgaagaaatacaagatgtctgtgctgttcaaacagatcctgagtgataccgagtccaagtcttttgtcattgataaactggaagatgactcagacgtggtcactaccatgcagagcttttatgagcagatcgccgctttcaagacagtggaggaaaaatctattaaggaaactctgagtctgctgttcgatgacctgaaagcccagaagctggacctgagtaagatctacttcaaaaacgataagagtctgacagacctgtcacagcaggtgtttgatgactattccgtgattgggaccgccgtcctggagtacattacacagcagatcgctccaaagaacctggataatccctctaagaaagagcaggaactgatcgctaagaaaaccgagaaggcaaaatatctgagtctggaaacaattaagctggcactggaggagttcaacaagcacagggatattgacaaacagtgccgctttgaggaaatcctggccaacttcgcagccatccccatgatttttgatgagatcgcccagaacaaagacaatctggctcagatcagtattaagtaccagaaccagggcaagaaagacctgctgcaggcttcagcagaagatgacgtgaaagccatcaaggatctgctggaccagaccaacaatctgctgcacaagctgaaaatcttccatattagtcagtcagaggataaggctaatatcctggataaagacgaacacttctacctggtgttcgaggaatgttacttcgagctggcaaacattgtccccctgtataacaagattaggaactacatcacacagaagccttactctgacgagaagtttaaactgaacttcgaaaatagtaccctggccaacgggtgggataagaacaaggagcctgacaacacagctatcctgttcatcaaggatgacaagtactatctgggagtgatgaataagaaaaacaataagatcttcgatgacaaagccattaaggagaacaaaggggaaggatacaagaaaatcgtgtataagctgctgcccggcgcaaataagatgctgcctaaggtgttcttcagcgccaagagtatcaaattctacaacccatccgaggacatcctgcggattagaaatcactcaacacatactaagaacgggagcccccagaagggatatgagaaatttgagttcaacatcgaggattgcaggaagtttattgacttctacaagcagagcatctccaaacaccctgaatggaaggattttggcttccggttttccgacacacagagatataactctatcgacgagttctaccgcgaggtggaaaatcaggggtataagctgacttttgagaacatttctgaaagttacatcgacagcgtggtcaatcagggaaagctgtacctgttccagatctataacaaagatttttcagcatacagcaagggcagaccaaacctgcatacactgtactggaaggccctgttcgatgagaggaatctgcaggacgtggtctataaactgaacggagaggccgaactgttttaccggaagcagtctattcctaagaaaatcactcacccagctaaggaggccatcgctaacaagaacaaggacaatcctaagaaagagagcgtgttcgaatacgatctgattaaggacaagcggttcaccgaagataagttctttttccattgtccaatcaccattaacttcaagtcaagcggcgctaacaagttcaacgacgagatcaatctgctgctgaaggaaaaagcaaacgatgtgcacatcctgagcattgaccgaggagagcggcatctggcctactataccctggtggatggcaaagggaatatcattaagcaggatacattcaacatcattggcaatgaccggatgaaaaccaactaccacgataaactggctgcaatcgagaaggatagagactcagctaggaaggactggaagaaaatcaacaacattaaggagatgaaggaaggctatctgagccaggtggtccatgagattgcaaagctggtcatcgaatacaatgccattgtggtgttcgaggatctgaacttcggctttaagagggggcgctttaaggtggaaaaacaggtctatcagaagctggagaaaatgctgatcgaaaagctgaattacctggtgtttaaagataacgagttcgacaagaccggaggcgtcctgagagcctaccagctgacagctccctttgaaactttcaagaaaatgggaaaacagacaggcatcatctactatgtgccagccggattcacttccaagatctgccccgtgaccggctttgtcaaccagctgtaccctaaatatgagtcagtgagcaagtcccaggaatttttcagcaagttcgataagatctgttataatctggacaaggggtacttcgagttttccttcgattacaagaacttcggcgacaaggccgctaaggggaaatggaccattgcctccttcggatctcgcctgatcaactttcgaaattccgataaaaaccacaattgggacactagggaggtgtacccaaccaaggagctggaaaagctgctgaaagactactctatcgagtatggacatggcgaatgcatcaaggcagccatctgtggcgagagtgataagaaatttttcgccaagctgacctcagtgctgaatacaatcctgcagatgcggaactcaaagaccgggacagaactggactatctgattagccccgtggctgatgtcaacggaaacttcttcgacagcagacaggcacccaaaaatatgcctcaggatgcagacgccaacggggcctaccacatcgggctgaagggactgatgctgctgggccggatcaagaacaatcaggaggggaagaagctgaacctggtcattaagaacgaggaatacttcgagtttgtccagaatagaaataacaaaaggccggcggccacgaaaaaggccggccaggcaaaaaagaaaaagggatcctacccatacgatgttccagattacgcttatccctacgacgtgcctgattatgcatacccatatgatgtccccgactatgcc

SEQ ID NO: 215 - DNA, 3834 bp, Artificial Sequence
  source: /note="Description of Artificial Sequence: Synthetic polynucleotide"
atggattacggcaacggccagtttgagcggagagcccccctgaccaagacaatcaccctgcgcctgaagcctatcggcgagacacgggagacaatccgcgagcagaagctgctggagcaggacgccgccttcagaaagctggtggagacagtgacccctatcgtggacgattgtatcaggaagatcgccgataacgccctgtgccactttggcaccgagtatgacttcagctgtctgggcaacgccatctctaagaatgacagcaaggccatcaagaaggagacagagaaggtggagaagctgctggccaaggtgctgaccgagaatctgccagatggcctgcgcaaggtgaacgacatcaattccgccgcctttatccaggatacactgacctctttcgtgcaggacgatgccgacaagcgggtgctgatccaggagctgaagggcaagaccgtgctgatgcagcggttcctgaccacacggatcacagccctgaccgtgtggctgcccgacagagtgttcgagaactttaatatcttcatcgagaacgccgagaagatgagaatcctgctggactcccctctgaatgagaagatcatgaagtttgacccagatgccgagcagtacgcctctctggagttctatggccagtgcctgtctcagaaggacatcgatagctacaacctgatcatctccggcatctatgccgacgatgaggtgaagaaccctggcatcaatgagatcgtgaaggagtacaatcagcagatccggggcgacaaggatgagtccccactgcccaagctgaagaagctgcacaagcagatcctgatgccagtggagaaggccttctttgtgcgcgtgctgtctaacgacagcgatgcccggagcatcctggagaagatcctgaaggacacagagatgctgccctccaagatcatcgaggccatgaaggaggcagatgcaggcgacatcgccgtgtacggcagccggctgcacgagctgagccacgtgatctacggcgatcacggcaagctgtcccagatcatctatgacaaggagtccaagaggatctctgagctgatggagacactgtctccaaaggagcgcaaggagagcaagaagcggctggagggcctggaggagcacatcagaaagtctacatacaccttcgacgagctgaacaggtatgccgagaagaatgtgatggcagcatacatcgcagcagtggaggagtcttgtgccgagatcatgagaaaggagaaggatctgaggaccctgctgagcaaggaggacgtgaagatccggggcaacagacacaatacactgatcgtgaagaactactttaatgcctggaccgtgttccggaacctgatcagaatcctgaggcgcaagtccgaggccgagatcgactctgacttctacgatgtgctggacgattccgtggaggtgctgtctctgacatacaagggcgagaatctgtgccgcagctatatcaccaagaagatcggctccgacctgaagcccgagatcgccacatacggcagcgccctgaggcctaacagccgctggtggtccccaggagagaagtttaatgtgaagttccacaccatcgtgcggagagatggccggctgtactatttcatcctgcccaagggcgccaagcctgtggagctggaggacatggatggcgacatcgagtgtctgcagatgagaaagatccctaacccaacaatctttctgcccaagctggtgttcaaggaccctgaggccttctttagggataatccagaggccgacgagttcgtgtttctgagcggcatgaaggcccccgtgacaatcaccagagagacatacgaggcctacaggtataagctgtataccgtgggcaagctgcgcgatggcgaggtgtccgaagaggagtacaagcgggccctgctgcaggtgctgaccgcctacaaggagtttctggagaacagaatgatctatgccgacctgaatttcggctttaaggatctggaggagtataaggacagctccgagtttatcaagcaggtggagacacacaacaccttcatgtgctgggccaaggtgtctagctcccagctggacgatctggtgaagtctggcaacggcctgctgttcgagatctggagcgagcgcctggagtcctactataagtacggcaatgagaaggtgctgcggggctatgagggcgtgctgctgagcatcctgaaggatgagaacctggtgtccatgcggaccctgctgaacagccggcccatgctggtgtaccggccaaaggagtctagcaagcctatggtggtgcaccgggatggcagcagagtggtggacaggtttgataaggacggcaagtacatcccccctgaggtgcacgacgagctgtatcgcttctttaacaatctgctgatcaaggagaagctgggcgagaaggcccggaagatcctggacaacaagaaggtgaaggtgaaggtgctggagagcgagagagtgaagtggtccaagttctacgatgagcagtttgccgtgaccttcagcgtgaagaagaacgccgattgtctggacaccacaaaggacctgaatgccgaagtgatggagcagtatagcgagtccaacagactgatcctgatcaggaataccacagatatcctgtactatctggtgctggacaagaatggcaaggtgctgaagcagagatccctgaacatcatcaatgacggcgccagggatgtggactggaaggagaggttccgccaggtgacaaaggatagaaacgagggctacaatgagtgggattattccaggacctctaacgacctgaaggaggtgtacctgaattatgccctgaaggagatcgccgaggccgtgatcgagtacaacgccatcctgatcatcgagaagatgtctaatgcctttaaggacaagtatagcttcctggacgacgtgaccttcaagggcttcgagacaaagctgctggccaagctgagcgatctgcactttaggggcatcaaggacggcgagccatgttccttcacaaaccccctgcagctgtgccagaacgattctaataagatcctgcaggacggcgtgatctttatggtgccaaattctatgacacggagcctggaccccgacaccggcttcatctttgccatcaacgaccacaatatcaggaccaagaaggccaagctgaactttctgagcaagttcgatcagctgaaggtgtcctctgagggctgcctgatcatgaagtacagcggcgattccctgcctacacacaacaccgacaatcgcgtgtggaactgctgttgcaatcacccaatcacaaactatgaccgggagacaaagaaggtggagttcatcgaggagcccgtggaggagctgtcccgcgtgctggaggagaatggcatcgagacagacaccgagctgaacaagctgaatgagcgggagaacgtgcctggcaaggtggtggatgccatctactctctggtgctgaattatctgcgcggcacagtgagcggagtggcaggacagagggccgtgtactatagccctgtgaccggcaagaagtacgatatctcctttatccaggccatgaacctgaataggaagtgtgactactataggatcggctccaaggagaggggagagtggaccgatttcgtggcccagctgatcaacaaaaggccggcggccacgaaaaaggccggccaggcaaaaaagaaaaagggatcctacccatacgatgttccagattacgcttatccctacgacgtgcctgattatgcatacccatatgatgtccccgactatgcc

SEQ ID NO: 216 - DNA, 4035 bp, Artificial Sequence; identical to SEQ ID NO: 214
  source: /note="Description of Artificial Sequence: Synthetic polynucleotide"

SEQ ID NO: 217 - DNA, 4575 bp, Artificial Sequence
  source: /note="Description of Artificial Sequence: Synthetic polynucleotide"
atgtccaacttctttaagaatttcaccaacctgtatgagctgtccaagacactgaggtttgagctgaagcccgtgggcgacaccctgacaaacatgaaggaccacctggagtacgatgagaagctgcagaccttcctgaaggatcagaatatcgacgatgcctatcaggccctgaagcctcagttcgacgagatccacgaggagtttatcacagattctctggagagcaagaaggccaaggagatcgacttctccgagtacctggatctgtttcaggagaagaaggagctgaacgactctgagaagaagctgcgcaacaagatcggcgagacattcaacaaggccggcgagaagtggaagaaggagaagtaccctcagtatgagtggaagaagggctccaagatcgccaatggcgccgacatcctgtcttgccaggatatgctgcagtttatcaagtataagaacccagaggatgagaagatcaagaattacatcgacgatacactgaagggcttctttacctatttcggcggctttaatcagaacagggccaactactatgagacaaagaaggaggcctccaccgcagtggcaacaaggatcgtgcacgagaacctgccaaagttctgtgacaatgtgatccagtttaagcacatcatcaagcggaagaaggatggcaccgtggagaaaaccgagagaaagaccgagtacctgaacgcctaccagtatctgaagaacaataacaagatcacacagatcaaggacgccgagacagagaagatgatcgagtctacacccatcgccgagaagatcttcgacgtgtactacttcagcagctgcctgagccagaagcagatcgaggagtacaaccggatcatcggccactataatctgctgatcaacctgtataaccaggccaagagatctgagggcaagcacctgagcgccaacgagaagaagtataaggacctgcctaagttcaagaccctgtataagcagatcggctgcggcaagaagaaggacctgttttacacaatcaagtgtgataccgaggaggaggccaataagtcccggaacgagggcaaggagtcccactctgtggaggagatcatcaacaaggcccaggaggccatcaataagtacttcaagtctaataacgactgtgagaatatcaacaccgtgcccgacttcatcaactatatcctgacaaaggagaattacgagggcgtgtattggagcaaggccgccatgaacaccatctccgacaagtacttcgccaattatcacgacctgcaggatagactgaaggaggccaaggtgtttcagaaggccgataagaagtccgaggacgatatcaagatcccagaggccatcgagctgtctggcctgttcggcgtgctggacagcctggccgattggcagaccacactgtttaagtctagcatcctgagcaacgaggacaagctgaagatcatcacagattcccagaccccctctgaggccctgctgaagatgatcttcaatgacatcgagaagaacatggagtcctttctgaaggagacaaacgatatcatcaccctgaagaagtataagggcaataaggagggcaccgagaagatcaagcagtggttcgactatacactggccatcaaccggatgctgaagtactttctggtgaaggagaataagatcaagggcaactccctggataccaatatctctgaggccctgaaaaccctgatctacagcgacgatgccgagtggttcaagtggtacgacgccctgagaaactatctgacccagaagcctcaggatgaggccaaggagaataagctgaagctgaatttcgacaacccatctctggccggcggctgggatgtgaacaaggagtgcagcaatttttgcgtgatcctgaaggacaagaacgagaagaagtacctggccatcatgaagaagggcgagaataccctgttccagaaggagtggacagagggccggggcaagaacctgacaaagaagtctaatccactgttcgagatcaataactgcgagatcctgagcaagatggagtatgacttttgggccgacgtgagcaagatgatccccaagtgtagcacccagctgaaggccgtggtgaaccacttcaagcagtccgacaatgagttcatctttcctatcggctacaaggtgacaagcggcgagaagtttagggaggagtgcaagatctccaagcaggacttcgagctgaataacaaggtgtttaataagaacgagctgagcgtgaccgccatgcgctacgatctgtcctctacacaggagaagcagtatatcaaggccttccagaaggagtactgggagctgctgtttaagcaggagaagcgggacaccaagctgacaaataacgagatcttcaacgagtggatcaatttttgcaacaagaagtatagcgagctgctgtcctgggagagaaagtacaaggatgccctgaccaattggatcaacttctgtaagtactttctgagcaagtatcccaagaccacactgttcaactactcttttaaggagagcgagaattataactccctggacgagttctaccgggacgtggatatctgttcttacaagctgaatatcaacaccacaatcaataagagcatcctggatagactggtggaggagggcaagctgtacctgtttgagatcaagaatcaggacagcaacgatggcaagtccatcggccacaagaataacctgcacaccatctactggaacgccatcttcgagaattttgacaacaggcctaagctgaatggcgaggccgagatcttctatcgcaaggccatctccaaggataagctgggcatcgtgaagggcaagaaaaccaagaacggcaccgagatcatcaagaattacagattcagcaaggagaagtttatcctgcacgtgccaatcaccctgaacttctgctccaataacgagtatgtgaatgacatcgtgaacacaaagttctacaatttttccaacctgcactttctgggcatcgataggggcgagaagcacctggcctactattctctggtgaataagaacggcgagatcgtggaccagggcacactgaacctgcctttcaccgacaaggatggcaatcagcgcagcatcaagaaggagaagtacttttataacaagcaggaggacaagtgggaggccaaggaggtggattgttggaattataacgacctgctggatgccatggcctctaaccgggacatggccagaaagaattggcagaggatcggcaccatcaaggaggccaagaacggctacgtgagcctggtcatcaggaagatcgccgatctggccgtgaataacgagcgccccgccttcatcgtgctggaggacctgaatacaggctttaagcggtccagacagaagatcgataagagcgtgtaccagaagttcgagctggccctggccaagaagctgaactttctggtggacaagaatgccaagcgcgatgagatcggctcccctacaaaggccctgcagctgaccccccctgtgaataactacggcgacattgagaacaagaagcaggccggcatcatgctgtatacccgggccaattatacctctcagacagatccagccacaggctggagaaagaccatctatctgaaggccggccccgaggagacaacatacaagaaggacggcaagatcaagaacaagagcgtgaaggaccagatcatcgagacattcaccgatatcggctttgacggcaaggattactatttcgagtacgacaagggcgagtttgtggatgagaaaaccggcgagatcaagcccaagaagtggcggctgtactccggcgagaatggcaagtccctggacaggttccgcggagagagggagaaggataagtatgagtggaagatcgacaagatcgatatcgtgaagatcctggacgatctgttcgtgaattttgacaagaacatcagcctgctgaagcagctgaaggagggcgtggagctgacccggaataacgagcacggcacaggcgagtccctgagattcgccatcaacctgatccagcagatccggaataccggcaataacgagagagacaacgatttcatcctgtccccagtgagggacgagaatggcaagcactttgactctcgcgagtactgggataaggagacaaagggcgagaagatcagcatgcccagctccggcgatgccaatggcgccttcaacatcgcccggaagggcatcatcatgaacgcccacatcctggccaatagcgactccaaggatctgtccctgttcgtgtctgacgaggagtgggatctgcacctgaataacaagaccgagtggaagaagcagctgaacatcttttctagcaggaaggccatggccaagcgcaagaagaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 218 - DNA, 4200 bp, Artificial Sequence
  source: /note="Description of Artificial Sequence: Synthetic polynucleotide"
atggagaacatcttcgaccagtttatcggcaagtacagcctgtccaagaccctgagattcgagctgaagcccgtgggcaagacagaggacttcctgaagatcaacaaggtgtttgagaaggatcagaccatcgacgatagctacaatcaggccaagttctattttgattccctgcaccagaagtttatcgacgccgccctggcctccgataagacatccgagctgtctttccagaactttgccgacgtgctggagaagcagaataagatcatcctggataagaagagagagatgggcgccctgaggaagcgcgacaagaacgccgtgggcatcgataggctgcagaaggagatcaatgacgccgaggatatcatccagaaggagaaggagaagatctacaaggacgtgcgcaccctgttcgataacgaggccgagtcttggaaaacctactatcaggagcgggaggtggacggcaagaagatcaccttcagcaaggccgacctgaagcagaagggcgccgattttctgacagccgccggcatcctgaaggtgctgaagtatgagttccccgaggagaaggagaaggagtttcaggccaagaaccagccctccctgttcgtggaggagaaggagaatcctggccagaagaggtacatcttcgactcttttgataagttcgccggctatctgaccaagtttcagcagacaaagaagaatctgtacgcagcagacggcaccagcacagcagtggccacccgcatcgccgataactttatcatcttccaccagaataccaaggtgttccgggacaagtacaagaacaatcacacagacctgggcttcgatgaggagaacatctttgagatcgagaggtataagaattgcctgctgcagcgcgagatcgagcacatcaagaatgagaatagctacaacaagatcatcggccggatcaataagaagatcaaggagtatcgggaccagaaggccaaggataccaagctgacaaagtccgacttccctttctttaagaacctggataagcagatcctgggcgaggtggagaaggagaagcagctgatcgagaaaacccgggagaaaaccgaggaggacgtgctgatcgagcggttcaaggagttcatcgagaacaatgaggagaggttcaccgccgccaagaagctgatgaatgccttctgtaacggcgagtttgagtccgagtacgagggcatctatctgaagaataaggccatcaacacaatctcccggagatggttcgtgtctgacagagattttgagctgaagctgcctcagcagaagtccaagaacaagtctgagaagaatgagccaaaggtgaagaagttcatctccatcgccgagatcaagaacgccgtggaggagctggacggcgatatctttaaggccgtgttctacgacaagaagatcatcgcccagggcggctctaagctggagcagttcctggtcatctggaagtacgagtttgagtatctgttccgggacatcgagagagagaacggcgagaagctgctgggctatgatagctgcctgaagatcgccaagcagctgggcatcttcccacaggagaaggaggcccgcgagaaggcaaccgccgtgatcaagaattacgccgacgccggcctgggcatcttccagatgatgaagtatttttctctggacgataaggatcggaagaacacccccggccagctgagcacaaatttctacgccgagtatgacggctactacaaggatttcgagtttatcaagtactacaacgagtttaggaacttcatcaccaagaagcctttcgacgaggataagatcaagctgaactttgagaatggcgccctgctgaagggctgggacgagaacaaggagtacgatttcatgggcgtgatcctgaagaaggagggccgcctgtatctgggcatcatgcacaagaaccaccggaagctgtttcagtccatgggcaatgccaagggcgacaacgccaatagataccagaagatgatctataagcagatcgccgacgcctctaaggatgtgcccaggctgctgctgaccagcaagaaggccatggagaagttcaagccttcccaggagatcctgagaatcaagaaggagaaaaccttcaagcgggagagcaagaacttttccctgagagatctgcacgccctgatcgagtactataggaactgcatccctcagtacagcaattggtccttttatgacttccagtttcaggataccggcaagtaccagaatatcaaggagttcacagacgatgtgcagaagtacggctataagatctcctttcgcgacatcgacgatgagtatatcaatcaggccctgaacgagggcaagatgtacctgttcgaggtggtgaacaaggatatctataacaccaagaatggctccaagaatctgcacacactgtactttgagcacatcctgtctgccgagaacctgaatgacccagtgttcaagctgtctggcatggccgagatctttcagcggcagcccagcgtgaacgaaagagagaagatcaccacacagaagaatcagtgtatcctggacaagggcgatagagcctacaagtataggcgctacaccgagaagaagatcatgttccacatgagcctggtgctgaacacaggcaagggcgagatcaagcaggtgcagtttaataagatcatcaaccagaggatcagctcctctgacaacgagatgagggtgaatgtgatcggcatcgatcgcggcgagaagaacctgctgtactatagcgtggtgaagcagaatggcgagatcatcgagcaggcctccctgaacgagatcaatggcgtgaactaccgggacaagctgatcgagagggagaaggagcgcctgaagaaccggcagagctggaagcctgtggtgaagatcaaggatctgaagaagggctacatctcccacgtgatccacaagatctgccagctgatcgagaagtattctgccatcgtggtgctggaggacctgaatatgagattcaagcagatcaggggaggaatcgagcggagcgtgtaccagcagttcgagaaggccctgatcgataagctgggctatctggtgtttaaggacaacagggatctgagggcaccaggaggcgtgctgaatggctaccagctgtctgccccctttgtgagcttcgagaagatgcgcaagcagaccggcatcctgttctacacacaggccgagtataccagcaagacagacccaatcaccggctttcggaagaacgtgtatatctctaatagcgcctccctggataagatcaaggaggccgtgaagaagttcgacgccatcggctgggatggcaaggagcagtcttacttctttaagtacaacccttacaacctggccgacgagaagtataagaactctaccgtgagcaaggagtgggccatctttgccagcgccccaagaatccggagacagaagggcgaggacggctactggaagtatgatagggtgaaagtgaatgaggagttcgagaagctgctgaaggtctggaattttgtgaacccaaaggccacagatatcaagcaggagatcatcaagaaggagaaggcaggcgacctgcagggagagaaggagctggatggccggctgagaaacttttggcactctttcatctacctgtttaacctggtgctggagctgcgcaattctttcagcctgcagatcaagatcaaggcaggagaagtgatcgcagtggacgagggcgtggacttcatcgccagcccagtgaagcccttctttaccacacccaacccttacatcccctccaacctgtgctggctggccgtggagaatgcagacgcaaacggagcctataatatcgccaggaagggcgtgatgatcctgaagaagatccgcgagcacgccaagaaggaccccgagttcaagaagctgccaaacctgtttatcagcaatgcagagtgggacgaggcagcccgggattggggcaagtacgcaggcaccacagccctgaacctggaccacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 219 - DNA, 3894 bp, Artificial Sequence
  source: /note="Description of Artificial Sequence: Synthetic polynucleotide"
atgcagaccctgtttgagaacttcacaaatcagtacccagtgtccaagaccctgcgctttgagctgatcccccagggcaagacaaaggacttcatcgagcagaagggcctgctgaagaaggatgaggaccgggccgagaagtataagaaggtgaagaacatcatcgatgagtaccacaaggacttcatcgagaagtctctgaatggcctgaagctggacggcctggagaagtacaagaccctgtatctgaagcaggagaaggacgataaggataagaaggcctttgacaaggagaaggagaacctgcgcaagcagatcgccaatgccttccggaacaatgagaagtttaagacactgttcgccaaggagctgatcaagaacgatctgatgtctttcgcctgcgaggaggacaagaagaatgtgaaggagtttgaggccttcaccacatacttcaccggcttccaccagaaccgcgccaatatgtacgtggccgatgagaagagaacagccatcgccagcaggctgatccacgagaacctgccaaagtttatcgacaatatcaagatcttcgagaagatgaagaaggaggcccccgagctgctgtctcctttcaaccagaccctgaaggatatgaaggacgtgatcaagggcaccacactggaggagatctttagcctggattatttcaacaagaccctgacacagagcggcatcgacatctacaattccgtgatcggcggcagaacccctgaggagggcaagacaaagatcaagggcctgaacgagtacatcaataccgacttcaaccagaagcagacagacaagaagaagcggcagccaaagttcaagcagctgtataagcagatcctgagcgataggcagagcctgtcctttatcgccgaggccttcaagaacgacaccgagatcctggaggccatcgagaagttttacgtgaatgagctgctgcacttcagcaatgagggcaagtccacaaacgtgctggacgccatcaagaatgccgtgtctaacctggagagctttaacctgaccaagatgtatttccgctccggcgcctctctgacagacgtgagccggaaggtgtttggcgagtggagcatcatcaatagagccctggacaactactatgccaccacatatccaatcaagcccagagagaagtctgagaagtacgaggagaggaaggagaagtggctgaagcaggacttcaacgtgagcctgatccagaccgccatcgatgagtacgacaacgagacagtgaagggcaagaacagcggcaaagtgatcgccgattattttgccaagttctgcgacgataaggagacagacctgatccagaaggtgaacgagggctacatcgccgtgaaggatctgctgaatacaccctgtcctgagaacgagaagctgggcagcaataaggaccaggtgaagcagatcaaggcctttatggattctatcatggacatcatgcacttcgtgcgccccctgagcctgaaggataccgacaaggagaaggatgagacattctactccctgttcacacctctgtacgaccacctgacccagacaatcgccctgtataacaaggtgcggaactatctgacccagaagccttacagcacagagaagatcaagctgaacttcgagaacagcaccctgctgggcggctgggatctgaataaggagacagacaacacagccatcatcctgaggaaggataacctgtactatctgggcatcatggacaagaggcacaatcgcatctttcggaacgtgcccaaggccgataagaaggacttctgctacgagaagatggtgtataagctgctgcctggcgccaacaagatgctgccaaaggtgttcttttctcagagcagaatccaggagtttaccccttccgccaagctgctggagaactacgccaatgagacacacaagaagggcgataatttcaacctgaatcactgtcacaagctgatcgatttctttaaggactctatcaacaagcacgaggattggaagaatttcgactttaggttcagcgccacctccacctacgccgacctgagcggcttttaccacgaggtggagcaccagggctacaagatctcttttcagagcgtggccgattccttcatcgacgatctggtgaacgagggcaagctgtacctgttccagatctataataaggacttttccccattctctaagggcaagcccaacctgcacaccctgtactggaagatgctgtttgatgagaacaatctgaaggacgtggtgtataagctgaatggcgaggccgaggtgttctaccgcaagaagagcattgccgagaagaacaccacaatccacaaggccaatgagtccatcatcaacaagaatcctgataacccaaaggccaccagcaccttcaactatgatatcgtgaaggacaagagatacaccatcgacaagtttcagttccacatcccaatcacaatgaactttaaggccgagggcatcttcaacatgaatcagagggtgaatcagttcctgaaggccaatcccgatatcaacatcatcggcatcgacagaggcgagaggcacctgctgtactatgccctgatcaaccagaagggcaagatcctgaagcaggataccctgaatgtgatcgccaacgagaagcagaaggtggactaccacaatctgctggataagaaggagggcgaccgcgcaaccgcaaggcaggagtggggcgtgatcgagacaatcaaggagctgaaggagggctatctgtcccaggtcatccacaagctgaccgatctgatgatcgagaacaatgccatcatcgtgatggaggacctgaactttggcttcaagcggggcagacagaaggtggagaagcaggtgtatcagaagtttgagaagatgctgatcgataagctgaattacctggtggacaagaataagaaggcaaacgagctgggaggcctgctgaacgcattccagctggccaataagtttgagtccttccagaagatgggcaagcagaacggctttatcttctacgtgcccgcctggaatacctctaagacagatcctgccaccggctttatcgacttcctgaagccccgctatgagaacctgaatcaggccaaggatttctttgagaagtttgactctatccggctgaacagcaaggccgattactttgagttcgcctttgacttcaagaatttcaccgagaaggccgatggcggcagaaccaagtggacagtgtgcaccacaaacgaggacagatatgcctggaatagggccctgaacaataacaggggcagccaggagaagtacgacatcacagccgagctgaagtccctgttcgatggcaaggtggactataagtctggcaaggatctgaagcagcagatcgccagccaggagtccgccgacttctttaaggccctgatgaagaacctgtccatcaccctgtctctgagacacaataacggcgagaagggcgataatgagcaggactacatcctgtcccctgtggccgattctaagggccgcttctttgactcccggaaggccgacgatgacatgccaaagaatgccgacgccaacggcgcctatcacatcgccctgaagggcctgtggtgtctggagcagatcagcaagaccgatgacctgaagaaggtgaagctggccatctccaacaaggagtggctggagttcgtgcagacactgaagggcaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 220 - DNA, 4065 bp, Artificial Sequence
  source: /note="Description of Artificial Sequence: Synthetic polynucleotide"
atgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctgctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 221 - DNA, 3762 bp, Artificial Sequence
  source: /note="Description of Artificial Sequence: Synthetic polynucleotide"
atgtactatgagtccctgaccaagcagtaccccgtgtctaagacaatccggaatgagctgatccctatcggcaagacactggataacatccgccagaacaatatcctggagagcgacgtgaagcggaagcagaactacgagcacgtgaagggcatcctggatgagtatcacaagcagctgatcaacgaggccctggacaattgcaccctgccatccctgaagatcgccgccgagatctacctgaagaatcagaaggaggtgtctgacagagaggatttcaacaagacacaggacctgctgaggaaggaggtggtggagaagctgaaggcccacgagaactttaccaagatcggcaagaaggacatcctggatctgctggagaagctgccttccatctctgaggacgattacaatgccctggagagcttccgcaacttttacacctatttcacatcctacaacaaggtgcgggagaatctgtattctgataaggagaagagctccacagtggcctacagactgatcaacgagaatttcccaaagtttctggacaatgtgaagagctataggtttgtgaaaaccgcaggcatcctggcagatggcctgggagaggaggagcaggactccctgttcatcgtggagacattcaacaagaccctgacacaggacggcatcgatacctacaattctcaagtgggcaagatcaactctagcatcaatctgtataaccagaagaatcagaaggccaatggcttcagaaagatccccaagatgaagatgctgtataagcagatcctgtccgatagggaggagtctttcatcgacgagtttcagagcgatgaggtgctgatcgacaacgtggagtcttatggcagcgtgctgatcgagtctctgaagtcctctaaggtgagcgccttctttgatgccctgagagagtctaagggcaagaacgtgtacgtgaagaatgacctggccaagacagccatgagcaacatcgtgttcgagaattggaggacctttgacgatctgctgaaccaggagtacgacctggccaacgagaacaagaagaaggacgataagtatttcgagaagcgccagaaggagctgaagaagaataagagctactccctggagcacctgtgcaacctgtccgaggattcttgtaacctgatcgagaattatatccaccagatctccgacgatatcgagaatatcatcatcaacaatgagacattcctgcgcatcgtgatcaatgagcacgacaggtcccgcaagctggccaagaaccggaaggccgtgaaggccatcaaggactttctggattctatcaaggtgctggagcgggagctgaagctgatcaacagctccggccaggagctggagaaggatctgatcgtgtactctgcccacgaggagctgctggtggagctgaagcaggtggacagcctgtataacatgaccagaaattatctgacaaagaagcctttctctaccgagaaggtgaagctgaactttaatcgcagcacactgctgaacggctgggatcggaataaggagacagacaacctgggcgtgctgctgctgaaggacggcaagtactatctgggcatcatgaacacaagcgccaataaggccttcgtgaatccccctgtggccaagaccgagaaggtgtttaagaaggtggattacaagctgctgccagtgcccaaccagatgctgccaaaggtgttctttgccaagagcaatatcgacttctataacccctctagcgagatctactccaattataagaagggcacccacaagaagggcaatatgttttccctggaggattgtcacaacctgatcgacttctttaaggagtctatcagcaagcacgaggactggagcaagttcggctttaagttcagcgatacagcctcctacaacgacatctccgagttctatcgcgaggtggagaagcagggctacaagctgacctatacagacatcgatgagacatacatcaatgatctgatcgagcggaacgagctgtacctgttccagatctataataaggactttagcatgtactccaagggcaagctgaacctgcacacactgtatttcatgatgctgtttgatcagcgcaatatcgacgacgtggtgtataagctgaacggagaggcagaggtgttctataggccagcctccatctctgaggacgagctgatcatccacaaggccggcgaggagatcaagaacaagaatcctaaccgggccagaaccaaggagacaagcaccttcagctacgacatcgtgaaggataagcggtatagcaaggataagtttaccctgcacatccccatcacaatgaacttcggcgtggatgaggtgaagcggttcaacgacgccgtgaacagcgccatccggatcgatgagaatgtgaacgtgatcggcatcgaccggggcgagagaaatctgctgtacgtggtggtcatcgactctaagggcaacatcctggagcagatctccctgaactctatcatcaataaggagtacgacatcgagacagattatcacgcactgctggatgagagggagggcggcagagataaggcccggaaggactggaacaccgtggagaatatcagggacctgaaggccggctacctgagccaggtggtgaacgtggtggccaagctggtgctgaagtataatgccatcatctgcctggaggacctgaactttggcttcaagaggggccgccagaaggtggagaagcaggtgtaccagaagttcgagaagatgctgatcgataagctgaattacctggtcatcgacaagagccgcgagcagacatcccctaaggagctgggaggcgccctgaacgcactgcagctgacctctaagttcaagagctttaaggagctgggcaagcagtccggcgtgatctactatgtgcctgcctacctgacctctaagatcgatccaaccacaggcttcgccaatctgttttatatgaagtgtgagaacgtggagaagtccaagagattctttgacggctttgatttcatcaggttcaacgccctggagaacgtgttcgagttcggctttgactaccggagcttcacccagagggcctgcggcatcaattccaagtggaccgtgtgcaccaacggcgagcgcatcatcaagtatcggaatccagataagaacaatatgttcgacgagaaggtggtggtggtgaccgatgagatgaagaacctgtttgagcagtacaagatcccctatgaggatggcagaaatgtgaaggacatgatcatcagcaacgaggaggccgagttctaccggagactgtataggctgctgcagcagaccctgcagatgagaaacagcacctccgacggcacaagggattacatcatctcccctgtgaagaataagagagaggcctacttcaacagcgagctgtccgacggctctgtgccaaaggacgccgatgccaacggcgcctacaatatcgccagaaagggcctgtgggtgctggagcagatcaggcagaagagcgagggcgagaagatcaatctggccatgaccaacgccgagtggctggagtatgcccagacacacctgctgaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 222 - DNA, 3858 bp, Artificial Sequence
  source: /note="Description of Artificial Sequence: Synthetic polynucleotide"
atgaacaattacgacgagttcaccaagctgtatcctatccagaaaaccatccggtttgagctgaagccacagggcagaaccatggagcacctggagacattcaacttctttgaggaggaccgggatagagccgagaagtataagatcctgaaggaggccatcgacgagtaccacaagaagtttatcgatgagcacctgaccaatatgtccctggattggaactctctgaagcagatcagcgagaagtactataagagcagggaggagaaggacaagaaggtgttcctgtccgagcagaagaggatgcgccaggagatcgtgtctgagtttaagaaggacgatcgcttcaaggacctgttttccaagaagctgttctctgagctgctgaaggaggagatctacaagaagggcaaccaccaggagatcgacgccctgaagagcttcgataagttttccggctatttcatcggcctgcacgagaataggaagaacatgtactccgacggcgatgagatcaccgccatctccaatcgcatcgtgaatgagaacttccccaagtttctggataacctgcagaagtaccaggaggccaggaagaagtatcctgagtggatcatcaaggccgagagcgccctggtggcccacaatatcaagatggacgaggtgttctccctggagtactttaataaggtgctgaaccaggagggcatccagcggtacaacctggccctgggcggctatgtgaccaagagcggcgagaagatgatgggcctgaatgatgccctgaacctggcccaccagtccgagaagagctccaagggcagaatccacatgacccccctgttcaagcagatcctgtccgagaaggagtccttctcttacatccccgacgtgtttacagaggattctcagctgctgcctagcatcggcggcttctttgcccagatcgagaatgacaaggatggcaacatcttcgaccgggccctggagctgatctctagctacgccgagtatgataccgagcggatctatatcagacaggccgacatcaatagagtgtccaacgtgatctttggagagtggggcaccctgggaggcctgatgagggagtacaaggccgactctatcaatgatatcaacctggagcgcacatgcaagaaggtggacaagtggctggattctaaggagtttgccctgagcgatgtgctggaggccatcaagaggaccggcaacaatgacgccttcaacgagtatatctccaagatgcggacagccagagagaagatcgatgccgcccgcaaggagatgaagttcatcagcgagaagatctccggcgatgaggagtctatccacatcatcaagaccctgctggacagcgtgcagcagttcctgcacttctttaatctgtttaaggcaaggcaggacatcccactggatggagccttctacgccgagtttgacgaggtgcacagcaagctgtttgccatcgtgcccctgtataacaaggtgcggaactatctgaccaagaacaatctgaacacaaagaagatcaagctgaatttcaagaaccctacactggccaatggctgggaccagaacaaggtgtacgattatgcctccctgatctttctgcgggacggcaattactatctgggcatcatcaatcctaagagaaagaagaacatcaagttcgagcagggctctggcaacggccccttctaccggaagatggtgtataagcagatccccggccctaataagaacctgccaagagtgttcctgacctccacaaagggcaagaaggagtataagccctctaaggagatcatcgagggctacgaggccgacaagcacatcaggggcgataagttcgacctggatttttgtcacaagctgatcgatttctttaaggagtccatcgagaagcacaaggactggtctaagttcaacttctacttcagcccaaccgagagctatggcgacatctctgagttctacctggatgtggagaagcagggctatcgcatgcactttgagaatatcagcgccgagacaatcgacgagtatgtggagaagggcgatctgtttctgttccagatctacaacaaggattttgtgaaggccgccaccggcaagaaggacatgcacacaatctactggaatgccgccttcagccccgagaacctgcaggacgtggtggtgaagctgaacggcgaggccgagctgttttatagggacaagtccgatatcaaggagatcgtgcaccgcgagggcgagatcctggtgaataggacctacaacggccgcacaccagtgcccgacaagatccacaagaagctgaccgattatcacaatggccggacaaaggacctgggcgaggccaaggagtacctggataaggtgagatacttcaaggcccactatgacatcaccaaggatcggagatacctgaacgacaagatctatttccacgtgcctctgaccctgaacttcaaggccaacggcaagaagaatctgaacaagatggtcatcgagaagttcctgtccgatgagaaggcccacatcatcggcatcgacaggggcgagcgcaatctgctgtactattccatcatcgacaggtctggcaagatcatcgatcagcagagcctgaatgtgatcgacggctttgattatcgggagaagctgaaccagagagagatcgagatgaaggatgcccgccagtcttggaacgccatcggcaagatcaaggacctgaaggagggctacctgagcaaggccgtgcacgagatcaccaagatggccatccagtataatgccatcgtggtcatggaggagctgaactacggcttcaagcggggccggttcaaggtggagaagcagatctatcagaagttcgagaatatgctgatcgataagatgaactacctggtgtttaaggacgcacctgatgagtccccaggaggcgtgctgaatgcctaccagctgacaaacccactggagtctttcgccaagctgggcaagcagaccggcatcctgttttacgtgccagccgcctatacatccaagatcgaccccaccacaggcttcgtgaatctgtttaacacctcctctaagacaaacgcccaggagcggaaggagttcctgcagaagtttgagagcatctcctattctgccaaggatggcggcatctttgccttcgcctttgactacagaaagttcggcaccagcaagacagatcacaagaacgtgtggaccgcctatacaaacggcgagaggatgcgctacatcaaggagaagaagcggaatgagctgtttgacccttctaaggagatcaaggaggccctgaccagctccggcatcaagtacgatggcggccagaacatcctgccagacatcctgaggagcaacaataacggcctgatctacacaatgtattctagcttcatcgccgccatccagatgcgcgtgtacgacggcaaggaggattatatcatcagccccatcaagaactccaagggcgagttctttaggaccgaccccaagaggcgcgagctgcctatcgacgccgatgccaatggcgcctacaacatcgccctgaggggagagctgacaatgagggcaatcgcagagaagttcgaccctgatagcgagaagatggccaagctggagctgaagcacaaggattggttcgagtttatgcagaccagaggcgacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 223 - DNA, 3990 bp, Artificial Sequence
  source: /note="Description of Artificial Sequence: Synthetic polynucleotide"
atgaacggcaataggtccatcgtgtaccgcgagttcgtgggcgtgatccccgtggccaagaccctgaggaatgagctgcgccctgtgggccacacacaggagcacatcatccagaacggcctgatccaggaggacgagctgcggcaggagaagagcaccgagctgaagaacatcatggacgattactatagagagtacatcgataagtctctgagcggcgtgaccgacctggacttcaccctgctgttcgagctgatgaacctggtgcagagctccccctccaaggacaataagaaggccctggagaaggagcagtctaagatgagggagcagatctgcacccacctgcagtccgactctaactacaagaatatctttaacgccaagctgctgaaggagatcctgcctgatttcatcaagaactacaatcagtatgacgtgaaggataaggccggcaagctggagacactggccctgtttaatggcttcagcacatactttaccgacttctttgagaagaggaagaacgtgttcaccaaggaggccgtgagcacatccatcgcctaccgcatcgtgcacgagaactccctgatcttcctggccaatatgacctcttataagaagatcagcgagaaggccctggatgagatcgaagtgatcgagaagaacaatcaggacaagatgggcgattgggagctgaatcagatctttaaccctgacttctacaatatggtgctgatccagtccggcatcgacttctacaacgagatctgcggcgtggtgaatgcccacatgaacctgtactgtcagcagaccaagaacaattataacctgttcaagatgcggaagctgcacaagcagatcctggcctacaccagcaccagcttcgaggtgcccaagatgttcgaggacgatatgagcgtgtataacgccgtgaacgccttcatcgacgagacagagaagggcaacatcatcggcaagctgaaggatatcgtgaataagtacgacgagctggatgagaagagaatctatatcagcaaggacttttacgagacactgagctgcttcatgtccggcaactggaatctgatcacaggctgcgtggagaacttctacgatgagaacatccacgccaagggcaagtccaaggaggagaaggtgaagaaggccgtgaaggaggacaagtacaagtctatcaatgacgtgaacgatctggtggagaagtatatcgatgagaaggagaggaatgagttcaagaacagcaatgccaagcagtacatccgcgagatctccaacatcatcaccgacacagagacagcccacctggagtatgacgatcacatctctctgatcgagagcgaggagaaggccgacgagatgaagaagcggctggatatgtatatgaacatgtaccactgggccaaggcctttatcgtggacgaggtgctggacagagatgagatgttctacagcgatatcgacgatatctataatatcctggagaacatcgtgccactgtataatcgggtgagaaactacgtgacccagaagccctacaactctaagaagatcaagctgaatttccagagccctacactggccaatggctggtcccagtctaaggagttcgacaacaatgccatcatcctgatcagagataacaagtactatctggccatcttcaatgccaagaacaagccagacaagaagatcatccagggcaactccgataagaagaacgacaacgattacaagaagatggtgtataacctgctgccaggcgccaacaagatgctgcccaaggtgtttctgtctaagaagggcatcgagacattcaagccctccgactatatcatctctggctacaacgcccacaagcacatcaagacaagcgagaattttgatatctccttctgtcgggacctgatcgattacttcaagaacagcatcgagaagcacgccgagtggagaaagtatgagttcaagttttccgccaccgacagctactccgatatctctgagttctatcgggaggtggagatgcagggctacagaatcgactggacatatatcagcgaggccgacatcaacaagctggatgaggagggcaagatctatctgtttcagatctacaataaggatttcgccgagaacagcaccggcaaggagaatctgcacacaatgtactttaagaacatcttctccgaggagaatctgaaggacatcatcatcaagctgaacggccaggccgagctgttttatcggagagcctctgtgaagaatcccgtgaagcacaagaaggatagcgtgctggtgaacaagacctacaagaatcagctggacaacggcgacgtggtgagaatccccatccctgacgatatctataacgagatctacaagatgtataatggctacatcaaggagtccgacctgtctgaggccgccaaggagtacctggataaggtggaggtgaggaccgcccagaaggacatcgtgaaggattaccgctatacagtggacaagtacttcatccacacacctatcaccatcaactataaggtgaccgcccgcaacaatgtgaatgatatggtggtgaagtacatcgcccagaacgacgatatccacgtgatcggcatcgaccggggcgagagaaacctgatctacatctccgtgatcgattctcacggcaacatcgtgaagcagaaatcctacaacatcctgaacaactacgactacaagaagaagctggtggagaaggagaaaacccgggagtacgccagaaagaactggaagagcatcggcaatatcaaggagctgaaggagggctatatctccggcgtggtgcacgagatcgccatgctgatcgtggagtacaacgccatcatcgccatggaggacctgaattatggctttaagaggggccgcttcaaggtggagcggcaggtgtaccagaagtttgagagcatgctgatcaataagctgaactatttcgccagcaaggagaagtccgtggacgagccaggaggcctgctgaagggctatcagctgacctacgtgcccgataatatcaagaacctgggcaagcagtgcggcgtgatcttttacgtgcctgccgccttcaccagcaagatcgacccatccacaggctttatctctgccttcaactttaagtctatcagcacaaatgcctctcggaagcagttctttatgcagtttgacgagatcagatactgtgccgagaaggatatgttcagctttggcttcgactacaacaacttcgatacctacaacatcacaatgggcaagacacagtggaccgtgtatacaaacggcgagagactgcagtctgagttcaacaatgccaggcgcaccggcaagacaaagagcatcaatctgacagagacaatcaagctgctgctggaggacaatgagatcaactacgccgacggccacgatatcaggatcgatatggagaagatggacgaggataagaagagcgagttctttgcccagctgctgagcctgtataagctgaccgtgcagatgcgcaattcctatacagaggccgaggagcaggagaacggcatctcttacgacaagatcatcagccctgtgatcaatgatgagggcgagttctttgactccgataactataaggagtctgacgataaggagtgcaagatgccaaaggacgccgatgccaacggcgcctactgtatcgccctgaagggcctgtatgaggtgctgaagatcaagagcgagtggaccgaggacggctttgataggaattgcctgaagctgccacacgcagagtggctggacttcatccagaacaagcggtacgagaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 224 - DNA, 4263 bp, Artificial Sequence
  source: /note="Description of Artificial Sequence: Synthetic polynucleotide"
atgctgttccaggactttacccacctgtatccactgtccaagacagtgagatttgagctgaagcccatcgataggaccctggagcacatccacgccaagaacttcctgtctcaggacgagacaatggccgatatgcaccagaaggtgaaagtgatcctggacgattaccaccgcgacttcatcgccgatatgatgggcgaggtgaagctgaccaagctggccgagttctatgacgtgtacctgaagtttcggaagaacccaaaggacgatgagctgcagaagcagctgaaggatctgcaggccgtgctgagaaaggagatcgtgaagcccatcggcaatggcggcaagtataaggccggctacgacaggctgttcggcgccaagctgtttaaggacggcaaggagctgggcgatctggccaagttcgtgatcgcacaggagggagagagctccccaaagctggcccacctggcccacttcgagaagttttccacctatttcacaggctttcacgataaccggaagaatatgtattctgacgaggataagcacaccgccatcgcctaccgcctgatccacgagaacctgccccggtttatcgacaatctgcagatcctgaccacaatcaagcagaagcactctgccctgtacgatcagatcatcaacgagctgaccgccagcggcctggacgtgtctctggccagccacctggatggctatcacaagctgctgacacaggagggcatcaccgcctacaatacactgctgggaggaatctccggagaggcaggctctcctaagatccagggcatcaacgagctgatcaattctcaccacaaccagcactgccacaagagcgagagaatcgccaagctgaggccactgcacaagcagatcctgtccgacggcatgagcgtgtccttcctgccctctaagtttgccgacgatagcgagatgtgccaggccgtgaacgagttctatcgccactacgccgacgtgttcgccaaggtgcagagcctgttcgacggctttgacgatcaccagaaggatggcatctacgtggagcacaagaacctgaatgagctgtccaagcaggccttcggcgactttgcactgctgggacgcgtgctggacggatactatgtggatgtggtgaatccagagttcaacgagcggtttgccaaggccaagaccgacaatgccaaggccaagctgacaaaggagaaggataagttcatcaagggcgtgcactccctggcctctctggagcaggccatcgagcactataccgcaaggcacgacgatgagagcgtgcaggcaggcaagctgggacagtacttcaagcacggcctggccggagtggacaaccccatccagaagatccacaacaatcacagcaccatcaagggctttctggagagggagcgccctgcaggagagagagccctgccaaagatcaagtccggcaagaatcctgagatgacacagctgaggcagctgaaggagctgctggataacgccctgaatgtggcccacttcgccaagctgctgaccacaaagaccacactggacaatcaggatggcaacttctatggcgagtttggcgtgctgtacgacgagctggccaagatccccaccctgtataacaaggtgagagattacctgagccagaagcctttctccaccgagaagtacaagctgaactttggcaatccaacactgctgaatggctgggacctgaacaaggagaaggataatttcggcgtgatcctgcagaaggacggctgctactatctggccctgctggacaaggcccacaagaaggtgtttgataacgcccctaatacaggcaagagcatctatcagaagatgatctataagtacctggaggtgaggaagcagttccccaaggtgttcttttccaaggaggccatcgccatcaactaccacccttctaaggagctggtggagatcaaggacaagggccggcagagatccgacgatgagcgcctgaagctgtatcggtttatcctggagtgtctgaagatccaccctaagtacgataagaagttcgagggcgccatcggcgacatccagctgtttaagaaggataagaagggcagagaggtgccaatcagcgagaaggacctgttcgataagatcaacggcatcttttctagcaagcctaagctggagatggaggacttctttatcggcgagttcaagaggtataacccaagccaggacctggtggatcagtataatatctacaagaagatcgactccaacgataatcgcaagaaggagaatttctacaacaatcaccccaagtttaagaaggatctggtgcggtactattacgagtctatgtgcaagcacgaggagtgggaggagagcttcgagttttccaagaagctgcaggacatcggctgttacgtggatgtgaacgagctgtttaccgagatcgagacacggagactgaattataagatctccttctgcaacatcaatgccgactacatcgatgagctggtggagcagggccagctgtatctgttccagatctacaacaaggacttttccccaaaggcccacggcaagcccaatctgcacaccctgtacttcaaggccctgttttctgaggacaacctggccgatcctatctataagctgaatggcgaggcccagatcttctacagaaaggcctccctggacatgaacgagacaacaatccacagggccggcgaggtgctggagaacaagaatcccgataatcctaagaagagacagttcgtgtacgacatcatcaaggataagaggtacacacaggacaagttcatgctgcacgtgccaatcaccatgaactttggcgtgcagggcatgacaatcaaggagttcaataagaaggtgaaccagtctatccagcagtatgacgaggtgaacgtgatcggcatcgatcggggcgagagacacctgctgtacctgaccgtgatcaatagcaagggcgagatcctggagcagtgttccctgaacgacatcaccacagcctctgccaatggcacacagatgaccacaccttaccacaagatcctggataagagggagatcgagcgcctgaacgcccgggtgggatggggcgagatcgagacaatcaaggagctgaagtctggctatctgagccacgtggtgcaccagatcagccagctgatgctgaagtacaacgccatcgtggtgctggaggacctgaatttcggctttaagaggggccgctttaaggtggagaagcagatctatcagaacttcgagaatgccctgatcaagaagctgaaccacctggtgctgaaggacaaggccgacgatgagatcggctcttacaagaatgccctgcagctgaccaacaatttcacagatctgaagagcatcggcaagcagaccggcttcctgttttatgtgcccgcctggaacacctctaagatcgaccctgagacaggctttgtggatctgctgaagccaagatacgagaacatcgcccagagccaggccttctttggcaagttcgacaagatctgctataatgccgacaaggattacttcgagtttcacatcgactacgccaagtttaccgataaggccaagaatagccgccagatctggacaatctgttcccacggcgacaagcggtacgtgtacgataagacagccaaccagaataagggcgccgccaagggcatcaacgtgaatgatgagctgaagtccctgttcgcccgccaccacatcaacgagaagcagcccaacctggtcatggacatctgccagaacaatgataaggagtttcacaagtctctgatgtacctgctgaaaaccctgctggccctgcggtacagcaacgcctcctctgacgaggatttcatcctgtcccccgtggcaaacgacgagggcgtgttctttaatagcgccctggccgacgatacacagcctcagaatgccgatgccaacggcgcctaccacatcgccctgaagggcctgtggctgctgaatgagctgaagaactccgacgatctgaacaaggtgaagctggccatcgacaatcagacctggctgaatttcgcccagaacaggaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 225 - DNA, 3933 bp, Artificial Sequence
  source: /note="Description of Artificial Sequence: Synthetic polynucleotide"
atggaggactattccggctttgtgaacatctactctatccagaaaaccctgaggttcgagctgaagccagtgggcaagacactggagcacatcgagaagaagggcttcctgaagaaggacaagatccgggccgaggattacaaggccgtgaagaagatcatcgataagtaccacagagcctatatcgaggaggtgtttgattccgtgctgcaccagaagaagaagaaggacaagacccgcttttctacacagttcatcaaggagatcaaggagttcagcgagctgtactataagaccgagaagaacatccccgacaaggagaggctggaggccctgagcgagaagctgcgcaagatgctggtgggcgcctttaagggcgagttctccgaggaggtggccgagaagtataagaacctgttttctaaggagctgatcaggaatgagatcgagaagttctgcgagacagacgaggagcgcaagcaggtgtctaacttcaagagcttcaccacatactttaccggcttccactccaacaggcagaatatctattccgacgagaagaagtctacagccatcggctaccgcatcatccaccagaacctgcctaagttcctggataatctgaagatcatcgagtccatccagcggcggttcaaggacttcccatggtctgatctgaagaagaacctgaagaagatcgataagaatatcaagctgaccgagtacttcagcatcgacggcttcgtgaacgtgctgaatcagaagggcatcgatgcctacaacacaatcctgggcggcaagtccgaggagtctggcgagaagatccagggcctgaacgagtacatcaatctgtatcggcagaagaacaatatcgacagaaagaacctgcccaatgtgaagatcctgtttaagcagatcctgggcgatagggagacaaagagctttatccctgaggccttcccagacgatcagtccgtgctgaactctatcacagagttcgccaagtacctgaagctggataagaagaagaagagcatcatcgccgagctgaagaagtttctgagctccttcaatcgctacgagctggacggcatctatctggccaacgataatagcctggcctctatcagcaccttcctgtttgacgattggtcctttatcaagaagtccgtgtctttcaagtatgacgagtccgtgggcgaccccaagaagaagatcaagtctcccctgaagtacgagaaggagaaggagaagtggctgaagcagaagtactatacaatctctttcctgaacgatgccatcgagagctattccaagtctcaggacgagaagagggtgaagatccgcctggaggcctactttgccgagttcaagagcaaggacgatgccaagaagcagttcgacctgctggagaggatcgaggaggcctatgccatcgtggagcctctgctgggagcagagtacccaagggaccgcaacctgaaggccgataagaaggaagtgggcaagatcaaggacttcctggatagcatcaagtccctgcagttctttctgaagcctctgctgtccgccgagatctttgacgagaaggatctgggcttctacaatcagctggagggctactatgaggagatcgattctatcggccacctgtataacaaggtgcggaattatctgaccggcaagatctacagcaaggagaagtttaagctgaacttcgagaacagcaccctgctgaagggctgggacgagaaccgggaggtggccaatctgtgcgtgatcttcagagaggaccagaagtactatctgggcgtgatggataaggagaacaataccatcctgtccgacatccccaaggtgaagcctaacgagctgttttacgagaagatggtgtataagctgatccccacacctcacatgcagctgccccggatcatcttctctagcgacaacctgtctatctataatcctagcaagtccatcctgaagatcagagaggccaagagctttaaggagggcaagaacttcaagctgaaggactgtcacaagtttatcgatttctacaaggagtctatcagcaagaatgaggactggagcagattcgacttcaagttcagcaagaccagcagctacgagaacatcagcgagttttaccgggaggtggagagacagggctataacctggacttcaagaaggtgtctaagttctacatcgacagcctggtggaggatggcaagctgtacctgttccagatctataacaaggacttttctatcttcagcaagggcaagcccaatctgcacaccatctattttcggtccctgttctctaaggagaacctgaaggacgtgtgcctgaagctgaatggcgaggccgagatgttctttcggaagaagtccatcaactacgatgagaagaagaagcgggagggccaccaccccgagctgtttgagaagctgaagtatcctatcctgaaggacaagagatacagcgaggataagtttcagttccacctgcccatcagcctgaacttcaagtccaaggagcggctgaactttaatctgaaagtgaatgagttcctgaagagaaacaaggacatcaatatcatcggcatcgatcggggcgagagaaacctgctgtacctggtcatgatcaatcagaagggcgagatcctgaagcagaccctgctggacagcatgcagtccggcaagggccggcctgagatcaactacaaggagaagctgcaggagaaggagatcgagagggataaggcccgcaagagctggggcacagtggagaatatcaaggagctgaaggagggctatctgtctatcgtgatccaccagatcagcaagctgatggtggagaacaatgccatcgtggtgctggaggacctgaacatcggctttaagcggggcagacagaaggtggagcggcaggtgtaccagaagttcgagaagatgctgatcgataagctgaactttctggtgttcaaggagaataagccaaccgagccaggaggcgtgctgaaggcctatcagctgacagacgagtttcagtctttcgagaagctgagcaagcagaccggctttctgttctacgtgccaagctggaacacctccaagatcgaccccagaacaggctttatcgatttcctgcaccctgcctacgagaatatcgagaaggccaagcagtggatcaacaagtttgattccatcaggttcaattctaagatggactggtttgagttcaccgccgatacacgcaagttttccgagaacctgatgctgggcaagaatcgggtgtgggtcatctgcaccacaaatgtggagcggtacttcaccagcaagaccgccaacagctccatccagtacaatagcatccagatcaccgagaagctgaaggagctgtttgtggacatccctttcagcaacggccaggatctgaagccagagatcctgaggaagaatgacgccgtgttctttaagagcctgctgttttacatcaagaccacactgtccctgcgccagaacaatggcaagaagggcgaggaggagaaggacttcatcctgagcccagtggtggattccaagggccggttctttaactctctggaggccagcgacgatgagcccaaggacgccgatgccaatggcgcctaccacatcgccctgaagggcctgatgaacctgctggtgctgaatgagacaaaggaggagaacctgagcagaccaaagtggaagatcaagaataaggactggctggagttcgtgtgggagaggaaccgcaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 226 - DNA, 3828 bp, Artificial Sequence
  source: /note="Description of Artificial Sequence: Synthetic polynucleotide"
atgagcaagctggagaagtttacaaactgctactccctgtctaagaccctgaggttcaaggccatccctgtgggcaagacccaggagaacatcgacaataagcggctgctggtggaggacgagaagagagccgaggattataagggcgtgaagaagctgctggatcgctactatctgtcttttatcaacgacgtgctgcacagcatcaagctgaagaatctgaacaattacatcagcctgttccggaagaaaaccagaaccgagaaggagaataaggagctggagaacctggagatcaatctgcggaaggagatcgccaaggccttcaagggcaacgagggctacaagtccctgtttaagaaggatatcatcgagacaatcctgccagagttcctggacgataaggacgagatcgccctggtgaacagcttcaatggctttaccacagccttcaccggcttctttgataacagagagaatatgttttccgaggaggccaagagcacatccatcgccttcaggtgtatcaacgagaatctgacccgctacatctctaatatggacatcttcgagaaggtggacgccatctttgataagcacgaggtgcaggagatcaaggagaagatcctgaacagcgactatgatgtggaggatttctttgagggcgagttctttaactttgtgctgacacaggagggcatcgacgtgtataacgccatcatcggcggcttcgtgaccgagagcggcgagaagatcaagggcctgaacgagtacatcaacctgtataatcagaaaaccaagcagaagctgcctaagtttaagccactgtataagcaggtgctgagcgatcgggagtctctgagcttctacggcgagggctatacatccgatgaggaggtgctggaggtgtttagaaacaccctgaacaagaacagcgagatcttcagctccatcaagaagctggagaagctgttcaagaattttgacgagtactctagcgccggcatctttgtgaagaacggccccgccatcagcacaatctccaaggatatcttcggcgagtggaacgtgatccgggacaagtggaatgccgagtatgacgatatccacctgaagaagaaggccgtggtgaccgagaagtacgaggacgatcggagaaagtccttcaagaagatcggctccttttctctggagcagctgcaggagtacgccgacgccgatctgtctgtggtggagaagctgaaggagatcatcatccagaaggtggatgagatctacaaggtgtatggctcctctgagaagctgttcgacgccgattttgtgctggagaagagcctgaagaagaacgacgccgtggtggccatcatgaaggacctgctggattctgtgaagagcttcgagaattacatcaaggccttctttggcgagggcaaggagacaaacagggacgagtccttctatggcgattttgtgctggcctacgacatcctgctgaaggtggaccacatctacgatgccatccgcaattatgtgacccagaagccctactctaaggataagttcaagctgtattttcagaaccctcagttcatgggcggctgggacaaggataaggagacagactatcgggccaccatcctgagatacggctccaagtactatctggccatcatggataagaagtacgccaagtgcctgcagaagatcgacaaggacgatgtgaacggcaattacgagaagatcaactataagctgctgcccggccctaataagatgctgccaaaggtgttcttttctaagaagtggatggcctactataaccccagcgaggacatccagaagatctacaagaatggcacattcaagaagggcgatatgtttaacctgaatgactgtcacaagctgatcgacttctttaaggatagcatctcccggtatccaaagtggtccaatgcctacgatttcaacttttctgagacagagaagtataaggacatcgccggcttttacagagaggtggaggagcagggctataaggtgagcttcgagtctgccagcaagaaggaggtggataagctggtggaggagggcaagctgtatatgttccagatctataacaaggacttttccgataagtctcacggcacacccaatctgcacaccatgtacttcaagctgctgtttgacgagaacaatcacggacagatcaggctgagcggaggagcagagctgttcatgaggcgcgcctccctgaagaaggaggagctggtggtgcacccagccaactcccctatcgccaacaagaatccagataatcccaagaaaaccacaaccctgtcctacgacgtgtataaggataagaggttttctgaggaccagtacgagctgcacatcccaatcgccatcaataagtgccccaagaacatcttcaagatcaatacagaggtgcgcgtgctgctgaagcacgacgataacccctatgtgatcggcatcgataggggcgagcgcaatctgctgtatatcgtggtggtggacggcaagggcaacatcgtggagcagtattccctgaacgagatcatcaacaacttcaacggcatcaggatcaagacagattaccactctctgctggacaagaaggagaaggagaggttcgaggcccgccagaactggacctccatcgagaatatcaaggagctgaaggccggctatatctctcaggtggtgcacaagatctgcgagctggtggagaagtacgatgccgtgatcgccctggaggacctgaactctggctttaagaatagccgcgtgaaggtggagaagcaggtgtatcagaagttcgagaagatgctgatcgataagctgaactacatggtggacaagaagtctaatccttgtgcaacaggcggcgccctgaagggctatcagatcaccaataagttcgagagctttaagtccatgtctacccagaacggcttcatcttttacatccctgcctggctgacatccaagatcgatccatctaccggctttgtgaacctgctgaaaaccaagtataccagcatcgccgattccaagaagttcatcagctcctttgacaggatcatgtacgtgcccgaggaggatctgttcgagtttgccctggactataagaacttctctcgcacagacgccgattacatcaagaagtggaagctgtactcctacggcaaccggatcagaatcttccggaatcctaagaagaacaacgtgttcgactgggaggaggtgtgcctgaccagcgcctataaggagctgttcaacaagtacggcatcaattatcagcagggcgatatcagagccctgctgtgcgagcagtccgacaaggccttctactctagctttatggccctgatgagcctgatgctgcagatgcggaacagcatcacaggccgcaccgacgtggattttctgatcagccctgtgaagaactccgacggcatcttctacgatagccggaactatgaggcccaggagaatgccatcctgccaaagaacgccgacgccaatggcgcctataacatcgccagaaaggtgctgtgggccatcggccagttcaagaaggccgaggacgagaagctggataaggtgaagatcgccatctctaacaaggagtggctggagtacgcccagaccagcgtgaagcacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 227 - DNA, 3924 bp, Artificial Sequence
  source: /note="Description of Artificial Sequence: Synthetic polynucleotide"
atggacagcctgaaggatttcaccaacctgtaccccgtgtccaagacactgcggtttgagctgaagcctgtgggcaagaccctggagaatatcgagaaggccggcatcctgaaggaggatgagcacagagccgagagctaccggagagtgaagaagatcatcgatacatatcacaaggtgttcatcgacagctccctggagaacatggccaagatgggcatcgagaatgagatcaaggccatgctgcagtccttttgcgagctgtataagaaggaccacaggaccgagggagaggacaaggccctggataagatcagggccgtgctgaggggcctgatcgtgggagccttcaccggcgtgtgcggccggcgggagaacacagtgcagaatgagaagtatgagagcctgtttaaggagaagctgatcaaggagatcctgccagatttcgtgctgtctacagaggccgagtccctgcccttttctgtggaggaggccaccagaagcctgaaggagttcgactcctttacatcttacttcgccggcttttatgagaaccggaagaatatctactctaccaagccccagagcacagccatcgcctatagactgatccacgagaacctgcctaagttcatcgataatatcctggtgtttcagaagatcaaggagccaatcgccaaggagctggagcacatcagggcagacttcagcgccggcggctacatcaagaaggatgagcgcctggaggacatcttttccctgaactactatatccacgtgctgtctcaggccggcatcgagaagtacaatgccctgatcggcaagatcgtgaccgagggcgatggcgagatgaagggcctgaacgagcacatcaacctgtataatcagcagaggggccgcgaggaccggctgccactgttcagacccctgtataagcagatcctgtctgatagggagcagctgtcctatctgccagagtctttcgagaaggacgaggagctgctgagggccctgaaggagttttacgatcacatcgcagaggacatcctgggaaggacccagcagctgatgacaagcatctccgagtacgatctgtcccggatctatgtgagaaacgatagccagctgaccgacatctccaagaagatgctgggcgattggaatgccatctacatggcccgggagagagcctatgaccacgagcaggcccccaagcgcatcacagccaagtacgagagggaccgcatcaaggccctgaagggcgaggagtctatcagcctggccaacctgaacagctgcatcgccttcctggacaacgtgagggattgtcgcgtggacacctatctgtctacactgggacagaaggagggacctcacggcctgagcaacctggtggagaacgtgttcgcctcctaccacgaggccgagcagctgctgtcttttccctatcctgaggagaacaatctgatccaggacaaggataacgtggtgctgatcaagaacctgctggataatatcagcgacctgcagaggttcctgaagccactgtggggcatgggcgatgagcccgacaaggatgagaggttttacggcgagtacaattatatcaggggcgccctggaccaggtcatccctctgtataacaaggtgcggaattatctgacccgcaagccatactccacacgcaaggtgaagctgaacttcggcaatagccagctgctgtccggctgggataggaacaaggagaaggacaattcttgcgtgatcctgcgcaagggccagaacttctacctggccatcatgaacaatcggcacaagcggagcttcgagaataagatgctgcccgagtataaggagggcgagccttacttcgagaagatggattataagtttctgccagaccccaacaagatgctgcccaaggtgttcctgtctaagaagggcatcgagatctacaagcctagcccaaagctgctggagcagtatggccacggcacccacaagaagggcgataccttcagcatggacgatctgcacgagctgatcgacttctttaagcactccatcgaggcccacgaggattggaagcagttcggctttaagttcagcgacaccgccacatacgagaacgtgagcagcttctaccgggaggtggaggaccagggctacaagctgtcttttagaaaggtgtccgagtcttacgtgtatagcctgatcgatcagggcaagctgtacctgttccagatctataacaaggactttagcccttgttccaagggcaccccaaatctgcacacactgtactggcggatgctgttcgatgagagaaacctggccgacgtgatctataagctggatggcaaggccgagatcttctttcgggagaagtccctgaagaatgaccacccaacccaccctgcaggcaagcccatcaagaagaagagccggcagaagaagggcgaggagagcctgttcgagtacgatctggtgaaggaccggagatataccatggataagtttcagttccacgtgccaatcacaatgaactttaagtgctctgccggcagcaaggtgaacgacatggtgaatgcccacatcagggaggccaaggacatgcacgtgatcggcatcgataggggcgagcgcaatctgctgtatatctgcgtgatcgacagccgcggcaccatcctggatcagatctccctgaacacaatcaatgacatcgattatcacgatctgctggagtccagggacaaggatcgccagcaggagcacaggaactggcagaccatcgagggcatcaaggagctgaagcagggctacctgtctcaggccgtgcaccgcatcgccgagctgatggtggcctataaggccgtggtggccctggaggacctgaacatgggcttcaagcggggcagacagaaggtggagagcagcgtgtaccagcagtttgagaagcagctgatcgacaagctgaattatctggtggataagaagaagcggcccgaggacatcggaggcctgctgagagcctaccagttcaccgcccctttcaagagctttaaggagatgggcaagcagaacggctttctgttctatatccctgcctggaacacatccaatatcgacccaaccacaggcttcgtgaacctgtttcacgtgcagtacgagaatgtggataaggccaagagcttctttcagaagttcgacagcatctcctacaaccctaagaaggattggtttgagttcgcctttgactataagaacttcaccaagaaggccgagggctctaggagcatgtggattctgtgcacccacggctcccggatcaagaacttcagaaattctcagaagaatggccagtgggatagcgaggagtttgccctgaccgaggccttcaagtccctgtttgtgcggtacgagatcgattataccgccgacctgaaaaccgccatcgtggacgagaagcagaaggatttctttgtggacctgctgaagctgttcaagctgaccgtgcagatgagaaactcctggaaggagaaggacctggattacctgatctctccagtggccggcgccgatggcaggttctttgacacacgcgagggcaataagagcctgcccaaggacgcagatgcaaacggagcctataatatcgccctgaagggcctgtgggcactgaggcagatcagacagacctccgagggcggcaagctgaagctggccatctctaacaaggagtggctgcagtttgtgcaggagagatcctacgagaaggacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 228 - DNA, 4113 bp, Artificial Sequence
  source: /note="Description of Artificial Sequence: Synthetic polynucleotide"
atggagaactatcaggagttcaccaacctgtttcagctgaataagacactgagattcgagctgaagcccatcggcaagacctgcgagctgctggaggagggcaagatcttcgccagcggctcctttctggagaaggacaaggtgagggccgataacgtgagctacgtgaagaaggagatcgacaagaagcacaagatctttatcgaggagacactgagctccttctctatcagcaacgatctgctgaagcagtactttgactgctataatgagctgaaggccttcaagaaggactgtaagagcgatgaggaggaggtgaagaaaaccgccctgcgcaacaagtgtacctccatccagagggccatgcgcgaggccatctctcaggcctttctgaagagcccccagaagaagctgctggccatcaagaacctgatcgagaacgtgttcaaggccgacgagaatgtgcagcacttctccgagtttaccagctatttctccggctttgagacaaacagagagaatttctactctgacgaggagaagtccacatctatcgcctataggctggtgcacgataacctgcctatcttcatcaagaacatctacatcttcgagaagctgaaggagcagttcgacgccaagaccctgagcgagatcttcgagaactacaagctgtatgtggccggctctagcctggatgaggtgttctccctggagtactttaacaataccctgacacagaagggcatcgacaactataatgccgtgatcggcaagatcgtgaaggaggataagcaggagatccagggcctgaacgagcacatcaacctgtataatcagaagcacaaggaccggagactgcccttctttatctccctgaagaagcagatcctgtccgatcgggaggccctgtcttggctgcctgacatgttcaagaatgattctgaagtgatcaaggccctgaagggcttctacatcgaggacggctttgagaacaatgtgctgacacctctggccaccctgctgtcctctctggataagtacaacctgaatggcatctttatccgcaacaatgaggccctgagctccctgtcccagaacgtgtatcggaatttttctatcgacgaggccatcgatgccaacgccgagctgcagaccttcaacaattacgagctgatcgccaatgccctgcgcgccaagatcaagaaggagacaaagcagggccggaagtctttcgagaagtacgaggagtatatcgataagaaggtgaaggccatcgacagcctgtccatccaggagatcaacgagctggtggagaattacgtgagcgagtttaactctaatagcggcaacatgccaagaaaggtggaggactacttcagcctgatgaggaagggcgacttcggctccaacgatctgatcgaaaatatcaagaccaagctgagcgccgcagagaagctgctgggcacaaagtaccaggagacagccaaggacatcttcaagaaggatgagaactccaagctgatcaaggagctgctggacgccaccaagcagttccagcactttatcaagccactgctgggcacaggcgaggaggcagatcgggacctggtgttctacggcgattttctgcccctgtatgagaagtttgaggagctgaccctgctgtataacaaggtgcggaatagactgacacagaagccctattccaaggacaagatccgcctgtgcttcaacaagcctaagctgatgacaggctgggtggattccaagaccgagaagtctgacaacggcacacagtacggcggctatctgtttcggaagaagaatgagatcggcgagtacgattattttctgggcatctctagcaaggcccagctgttcagaaagaacgaggccgtgatcggcgactacgagaggctggattactatcagccaaaggccaataccatctacggctctgcctatgagggcgagaacagctacaaggaggacaagaagcggctgaacaaagtgatcatcgcctatatcgagcagatcaagcagacaaacatcaagaagtctatcatcgagtccatctctaagtatcctaatatcagcgacgatgacaaggtgaccccatcctctctgctggagaagatcaagaaggtgtctatcgacagctacaacggcatcctgtccttcaagtcttttcagagcgtgaacaaggaagtgatcgataacctgctgaaaaccatcagccccctgaagaacaaggccgagtttctggacctgatcaataaggattatcagatcttcaccgaggtgcaggccgtgatcgacgagatctgcaagcagaaaaccttcatctactttccaatctccaacgtggagctggagaaggagatgggcgataaggacaagcccctgtgcctgttccagatcagcaataaggatctgtccttcgccaagacctttagcgccaacctgcggaagaagagaggcgccgagaatctgcacacaatgctgtttaaggccctgatggagggcaaccaggataatctggacctgggctctggcgccatcttctacagagccaagagcctggacggcaacaagcccacacaccctgccaatgaggccatcaagtgtaggaacgtggccaataaggataaggtgtccctgttcacctacgacatctataagaacaggcgctacatggagaataagttcctgtttcacctgagcatcgtgcagaactataaggccgccaatgactccgcccagctgaacagctccgccaccgagtatatcagaaaggccgatgacctgcacatcatcggcatcgataggggcgagcgcaatctgctgtactattccgtgatcgatatgaagggcaacatcgtggagcaggactctctgaatatcatcaggaacaatgacctggagacagattaccacgacctgctggataagagggagaaggagcgcaaggccaaccggcagaattgggaggccgtggagggcatcaaggacctgaagaagggctacctgagccaggccgtgcaccagatcgcccagctgatgctgaagtataacgccatcatcgccctggaggatctgggccagatgtttgtgacccgcggccagaagatcgagaaggccgtgtaccagcagttcgagaagagcctggtggataagctgtcctacctggtggacaagaagcggccttataatgagctgggcggcatcctgaaggcctaccagctggcctctagcatcaccaagaacaattctgacaagcagaacggcttcctgttttatgtgccagcctggaatacaagcaagatcgatcccgtgaccggctttacagacctgctgcggcccaaggccatgaccatcaaggaggcccaggacttctttggcgccttcgataacatctcttacaatgacaagggctatttcgagtttgagacaaactacgacaagtttaagatcagaatgaagagcgcccagaccaggtggacaatctgcaccttcggcaatcggatcaagagaaagaaggataagaactactggaattatgaggaggtggagctgaccgaggagttcaagaagctgtttaaggacagcaacatcgattacgagaactgtaatctgaaggaggagatccagaacaaggacaatcgcaagttctttgatgacctgatcaagctgctgcagctgacactgcagatgcggaactccgatgacaagggcaatgattatatcatctctcctgtggccaacgccgagggccagttctttgactcccgcaatggcgataagaagctgccactggatgcagacgcaaacggagcctacaatatcgcccgcaagggcctgtggaacatccggcagatcaagcagaccaagaacgacaagaagctgaatctgagcatctcctctacagagtggctggatttcgtgcgggagaagccttacctgaagaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 229 - DNA, 3882 bp, Artificial Sequence
  source: /note="Description of Artificial Sequence: Synthetic polynucleotide"
atgaaaacccagcacttctttgaggacttcacaagcctgtactctctgagcaagaccatccggtttgagctgaagccaatcggcaagaccctggagaacatcaagaagaatggcctgatccggagagatgagcagagactggacgattacgagaagctgaagaaagtgatcgacgagtatcacgaggatttcatcgccaacatcctgagctccttttccttctctgaggagatcctgcagtcctacatccagaatctgagcgagtccgaggccagggccaagatcgagaaaaccatgcgcgacacactggccaaggccttctctgaggatgagaggtacaagagcatctttaagaaggagctggtgaagaaggacatccccgtgtggtgccctgcctataagagcctgtgcaagaagttcgataactttaccacatctctggtgcccttccacgagaacaggaagaacctgtataccagcaatgagatcacagcctctatcccttatcgcatcgtgcacgtgaacctgccaaagtttatccagaatatcgaggccctgtgcgagctgcagaagaagatgggcgccgacctgtacctggagatgatggagaacctgcgcaacgtgtggcccagcttcgtgaaaaccccagacgacctgtgcaacctgaaaacctataatcacctgatggtgcagtctagcatcagcgagtacaacaggtttgtgggcggctattccaccgaggacggcacaaagcaccagggcatcaacgagtggatcaatatctacagacagaggaataaggagatgcgcctgcctggcctggtgttcctgcacaagcagatcctggccaaggtggactcctctagcttcatcagcgatacactggagaacgacgatcaggtgttttgcgtgctgagacagttcaggaagctgttttggaataccgtgtcctctaaggaggacgatgccgcctccctgaaggacctgttctgtggcctgtctggctatgaccctgaggccatctacgtgagcgatgcccacctggccacaatctccaagaacatctttgacagatggaattacatctccgatgccatcaggcgcaagaccgaggtgctgatgccacggaagaaggagagcgtggagagatatgccgagaagatctccaagcagatcaagaagagacagtcttacagcctggccgagctggacgatctgctggcccactatagcgaggagtccctgcccgcaggcttctctctgctgagctactttacatctctgggcggccagaagtatctggtgagcgacggcgaagtgatcctgtacgaggagggcagcaacatctgggacgaggtgctgatcgccttcagggatctgcaggtcatcctggacaaggacttcaccgagaagaagctgggcaaggatgaggaggccgtgtctgtgatcaagaaggccctggacagcgccctgcgcctgcggaagttctttgatctgctgtccggcacaggcgcagagatcaggagagacagctccttctatgccctgtataccgaccggatggataagctgaagggcctgctgaagatgtatgataaggtgagaaactacctgaccaagaagccttattccatcgagaagttcaagctgcactttgacaacccatccctgctgtctggctgggataagaataaggagctgaacaatctgtctgtgatcttccggcagaacggctactattacctgggcatcatgacacccaagggcaagaatctgttcaagaccctgcctaagctgggcgccgaggagatgttttatgagaagatggagtacaagcagatcgccgagcctatgctgatgctgccaaaggtgttctttcccaagaaaaccaagccagccttcgccccagaccagagcgtggtggatatctacaacaagaaaaccttcaagacaggccagaagggctttaataagaaggacctgtaccggctgatcgacttctacaaggaggccctgacagtgcacgagtggaagctgtttaacttctccttttctccaaccgagcagtatcggaatatcggcgagttctttgacgaggtgagagagcaggcctacaaggtgtccatggtgaacgtgcccgcctcttatatcgacgaggccgtggagaacggcaagctgtatctgttccagatctacaataaggacttcagcccctactccaagggcatccctaacctgcacacactgtattggaaggccctgttcagcgagcagaatcagagccgggtgtataagctgtgcggaggaggagagctgttttatagaaaggccagcctgcacatgcaggacaccacagtgcaccccaagggcatctctatccacaagaagaacctgaataagaagggcgagacaagcctgttcaactacgacctggtgaaggataagaggtttaccgaggacaagttctttttccacgtgcctatctctatcaactacaagaataagaagatcaccaacgtgaatcagatggtgcgcgattatatcgcccagaacgacgatctgcagatcatcggcatcgaccgcggcgagcggaatctgctgtatatcagccggatcgatacaaggggcaacctgctggagcagttcagcctgaatgtgatcgagtccgacaagggcgatctgagaaccgactatcagaagatcctgggcgatcgcgagcaggagcggctgaggcgccggcaggagtggaagtctatcgagagcatcaaggacctgaaggatggctacatgagccaggtggtgcacaagatctgtaacatggtggtggagcacaaggccatcgtggtgctggagaacctgaatctgagcttcatgaagggcaggaagaaggtggagaagtccgtgtacgagaagtttgagcgcatgctggtggacaagctgaactatctggtggtggataagaagaacctgtccaatgagccaggaggcctgtatgcagcataccagctgaccaatccactgttctcttttgaggagctgcacagatacccccagagcggcatcctgtttttcgtggacccatggaacacctctctgacagatcccagcacaggcttcgtgaatctgctgggcagaatcaactacaccaatgtgggcgacgcccgcaagtttttcgatcggtttaacgccatcagatatgacggcaagggcaatatcctgttcgacctggatctgtccagatttgatgtgagggtggagacacagaggaagctgtggacactgaccacattcggctctcgcatcgccaaatccaagaagtctggcaagtggatggtggagcggatcgagaacctgagcctgtgctttctggagctgttcgagcagtttaatatcggctacagagtggagaaggacctgaagaaggccatcctgagccaggataggaaggagttctatgtgcgcctgatctacctgtttaacctgatgatgcagatccggaacagcgacggcgaggaggattatatcctgtctcccgccctgaacgagaagaatctgcagttcgacagcaggctgatcgaggccaaggatctgcctgtggacgcagatgcaaacggagcatacaatgtggcccgcaagggcctgatggtggtgcagagaatcaagaggggcgaccacgagtccatccacaggatcggaagggcacagtggctgagatatgtgcaggagggcatcgtggagaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 230 - protein, 1345 aa, Artificial Sequence
  source: /note="Description of Artificial Sequence: Synthetic polypeptide"
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNKRPAATKKAGQAKKKKGSYPYDVPDYAYPYDVPDYAYPYDVPDYA

SEQ ID NO: 231 - protein, 1278 aa, Artificial Sequence
  source: /note="Description of Artificial Sequence: Synthetic polypeptide"
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKLLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLINKRPAATKKAGQAKKKKGSYPYDVPDYAYPYDVPDYAYPYDVPDYA

SEQ ID NO: 232 - protein, 1286 aa, Artificial Sequence
  source: /note="Description of Artificial Sequence: Synthetic polypeptide"
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEKARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAVKRPAATKKAGQAKKKKGSYPYDVPDYAYPYDVPDYAYPYDVPDYA

SEQ ID NO: 233 - protein, 1522 aa, Artificial Sequence
  source: /note="Description of Artificial Sequence: Synthetic polypeptide"
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEDKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAIMKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTEIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDCWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKKAGQAKKKKGSYPYDVPDYAYPYDVPDYAYPYDVPDYA

SEQ ID NO: 234 - protein, 1397 aa, Artificial Sequence
  source: /note="Description of Artificial Sequence: Synthetic polypeptide"
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDHKRPAATKKAGQAKKKKGSYPYDVPDYAYPYDVPDYAYPYDVPDYA

SEQ ID NO: 235 - protein, 1295 aa, Artificial Sequence
  source: /note="Description of Artificial Sequence: Synthetic polypeptide"
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYAWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKGKRPAATKKAGQAKKKKGSYPYDVPDYAYPYDVPDYAYPYDVPDYA

SEQ ID NO: 236 - protein, 1352 aa, Artificial Sequence
  source: /note="Description of Artificial Sequence: Synthetic polypeptide"
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKGSYPYDVPDYAYPYDVPDYAYPYDVPDYA

SEQ ID NO: 237 - protein, 1251 aa, Artificial Sequence
  source: /note="Description of Artificial Sequence: Synthetic polypeptide"
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGYLSQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLLKRPAATKKAGQAKKKKGSYPYDVPDYAYPYDVPDYAYPYDVPDYA

SEQ ID NO: 238 - protein, 1283 aa, Artificial Sequence
  source: /note="Description of Artificial Sequence: Synthetic polypeptide"
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGDKRPAATKKAGQAKKKKGSYPYDVPDYAYPYDVPDYAYPYDVPDYA

SEQ ID NO: 239 - protein, 1327 aa, Artificial Sequence
  source: /note="Description of Artificial Sequence: Synthetic polypeptide"
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYEKRPAATKKAGQAKKKKGSYPYDVPDYAYPYDVPDYAYPYDVPDYA

SEQ ID NO: 240 - protein, 1418 aa, Artificial Sequence
  source: /note="Description of Artificial Sequence: Synthetic polypeptide"
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNRKRPAATKKAGQAKKKKGSYPYDVPDYAYPYDVPDYAYPYDVPDYA

SEQ ID NO: 241 - protein, 1308 aa, Artificial Sequence
  source: /note="Description of Artificial Sequence: Synthetic polypeptide"
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNRKRPAATKKAGQAKKKKGSYPYDVPDYAYPYDVPDYAYPYDVPDYA

SEQ ID NO: 242 - protein, 1273 aa, Artificial Sequence
  source: /note="Description of Artificial Sequence: Synthetic polypeptide"
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHKRPAATKKAGQAKKKKGSYPYDVPDYAYPYDVPDYAYPYDVPDYA

SEQ ID NO: 243 - protein, 1305 aa, Artificial Sequence
  source: /note="Description of Artificial Sequence: Synthetic polypeptide"
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKDKRPAATKKAGQAKKKKGSYPYDVPDYAYPYDVPDYAYPYDVPDYA

SEQ ID NO: 244 - protein, 1368 aa, Artificial Sequence
  source: /note="Description of Artificial Sequence: Synthetic polypeptide"
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLKKRPAATKKAGQAKKKKGSYPYDVPDYAYPYDVPDYAYPYDVPDYA

SEQ ID NO: 245 - protein, 1291 aa, Artificial Sequence
  source: /note="Description of Artificial Sequence: Synthetic polypeptide"
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVEKRPAATKKAGQAKKKKGSYPYDVPDYAYPYDVPDYAYPYDVPDYA

SEQ ID NO: 246 - DNA, 100 bp, Artificial Sequence
  source: /note="Description of Artificial Sequence: Synthetic polynucleotide"
cttgtggaaaggacgaaacaccgtaatttctactaagtgtagatttcttcatccctagccagccggccaacatgaggatcacccatgtctgcagggccag

SEQ ID NO: 247 - DNA, 64 bp, Artificial Sequence
  source: /note="Description of Artificial Sequence: Synthetic oligonucleotide"
cttgtggaaaggacgaaacaccgtaatttctactaagtgtagatattcttcatccctagccagc

SEQ ID NO: 248 - DNA, 100 bp, Artificial Sequence
  source: /note="Description of Artificial Sequence: Synthetic polynucleotide"
cttgtggaaaggacgaaacaccgggccaacatgaggatcacccatgtctgcagggccagtaatttctactaagtgtagatattcttcatccctagccagc

SEQ ID NO: 249 - DNA, 100 bp, Artificial Sequence
  source: /note="Description of Artificial Sequence: Synthetic polynucleotide"
cttgtggaaaggacgaaacaccgtaatttctactggccaacatgaggatcacccatgtctgcagggccagaagtgtagatattcttcatccctagccagc

SEQ ID NO: 250 - DNA, 100 bp, Artificial Sequence
  source: /note="Description of Artificial Sequence: Synthetic polynucleotide"
cttgtggaaaggacgaaacaccgtaatttctactaagtgtagatattcttcatccctagccagcggccaacatgaggatcacccatgtctgcagggccag

SEQ ID NO: 251 - DNA, 22 bp, Artificial Sequence
  source: /note="Description of Artificial Sequence: Synthetic oligonucleotide"
cttgtggaaaggacgaaacacc

SEQ ID NO: 252 - DNA, 64 bp, Artificial Sequence
  source: /note="Description of Artificial Sequence: Synthetic oligonucleotide"
cttgtggaaaggacgaaacaccgtaatttctactaagtgtagatacagaggaggacaaggctac

SEQ ID NO: 253 - DNA, 100 bp, Artificial Sequence
  source: /note="Description of Artificial Sequence: Synthetic polynucleotide"
cttgtggaaaggacgaaacaccgggccaacatgaggatcacccatgtctgcagggccagtaatttctactaagtgtagatacagaggaggacaaggctac

SEQ ID NO: 254 - DNA, 100 bp, Artificial Sequence
  source: /note="Description of Artificial Sequence: Synthetic polynucleotide"
cttgtggaaaggacgaaacaccgtaatttctactggccaacatgaggatcacccatgtctgcagggccagaagtgtagatacagaggaggacaaggctac

SEQ ID NO: 255 - DNA, 100 bp, Artificial Sequence
  source: /note="Description of Artificial Sequence: Synthetic polynucleotide"
cttgtggaaaggacgaaacaccgtaatttctactaagtgtagatacagaggaggacaaggctacggccaacatgaggatcacccatgtctgcagggccag

SEQ ID NO: 256 - DNA, 23 bp, Artificial Sequence
  source: /note="Description of Artificial Sequence: Synthetic oligonucleotide"
gaaagggcgtgccggagagccaa

SEQ ID NO: 257 - DNA, 23 bp, Artificial Sequence
  source: /note="Description of Artificial Sequence: Synthetic oligonucleotide"
caaacctctccaacacccgactg

SEQ ID NO: 258 - DNA, 23 bp, Artificial Sequence
  source: /note="Description of Artificial Sequence: Synthetic oligonucleotide"
tccgtagtagcctaaacgccccg

SEQ ID NO: 259 - DNA, 23 bp, Artificial Sequence
  source: /note="Description of Artificial Sequence: Synthetic oligonucleotide"
ggctactacggataaatagccca

SEQ ID NO: 260 - DNA, 23 bp, Artificial Sequence
  source: /note="Description of Artificial Sequence: Synthetic oligonucleotide"
ttcagccgggagtccggcacgcg

SEQ ID NO: 261 - DNA, 23 bp, Artificial Sequence
  source: /note="Description of Artificial Sequence: Synthetic oligonucleotide"
ttgttgcagtgcgtgcgcctggc

SEQ ID NO: 262 - DNA, 23 bp, Artificial Sequence
  source: /note="Description of Artificial Sequence: Synthetic oligonucleotide"
caaggagcgggagaaaggaacgg

SEQ ID NO: 263 - DNA, 23 bp, Artificial Sequence
  source: /note="Description of Artificial Sequence: Synthetic oligonucleotide"
tcccgctccttgcaaactctcca

SEQ ID NO: 264 - DNA, 23 bp, Artificial Sequence
  source: /note="Description of Artificial Sequence: Synthetic oligonucleotide"
gggagtgggtgggaggaagaggt

SEQ ID NO: 265 - DNA, 23 bp, Artificial Sequence
  source: /note="Description of Artificial Sequence: Synthetic oligonucleotide"
aatgggacacccagccccacgcg

SEQ ID NO: 266 - DNA, 122 bp, Artificial Sequence
  source: /note="Description of Artificial Sequence: Synthetic primer"
aacacaggaccggtgccaccatgtacccatacgatgttccagattacgcttcgccgaagaaaaagcgcaaggtcgaagcgtccacacagttcgagggctttaccaacctgtatcaggtgagc

SEQ ID NO: 267 - DNA, 94 bp, Artificial Sequence
  source: /note="Description of Artificial Sequence: Synthetic primer"
gcggccgcacacaaaaaaccaacacacagatctaatgaaaataaagatcttttattgaattcttagttgcgcagctcctggatgtaggccagcc

SEQ ID NO: 268 - DNA, 118 bp, Artificial Sequence
  source: /note="Description of Artificial Sequence: Synthetic primer"
taccggatccccgggtaccggtatgtacccatacgatgttccagattacgcttcgccgaagaaaaagcgcaaggtcgaagcgtccagcaagctggagaagtttacaaactgctactcc

SEQ ID NO: 269 - DNA, 115 bp, Artificial Sequence
  source: /note="Description of Artificial Sequence: Synthetic primer"
gcggccgcacacaaaaaaccaacacacagatctaatgaaaataaagatcttttattgaattcttagtgcttcacgctggtctgggcgtactccagccactccttgttagagatgg

SEQ ID NO: 270 - DNA, 397 bp, Artificial Sequence
  source: /note="Description of Artificial Sequence: Synthetic polynucleotide"
cctacgctagcctgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatttctactcttgtagatcctgcctctgcgggctcagctaatttctactcttgtagatcggcgggtctcagggttgtctaatttctactcttgtagatctgtcgctgctcatcctgtcttttttcgacgcgt

SEQ ID NO: 271 - DNA, 397 bp, Artificial Sequence
  source: /note="Description of Artificial Sequence: Synthetic polynucleotide"
cctacgctagcctgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatttctactcttgtagatttcacctttttaaacttgagtaatttctactcttgtagatgggttcctatggtaggcccctaatttctactcttgtagattcatctccttggccgtgtcattttttcgacgcgt

SEQ ID NO: 272 - DNA, 397 bp, Artificial Sequence
  source: /note="Description of Artificial Sequence: Synthetic polynucleotide"
cctacgctagcctgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatttctactcttgtagatcctgcctctgctggctctgctaatttctactcttgtagatcggcgggtctcagggttgtctaatttctactcttgtagattgtccctgcttatcctgtccttttttcgacgcgt

SEQ ID NO: 273 - DNA, 397 bp, Artificial Sequence
  source: /note="Description of Artificial Sequence: Synthetic polynucleotide"
cctacgctagcctgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatttctactcttgtagatttcgccttcttaaacttcagtaatttctactcttgtagatgtgtccctatggtaggtccctaatttctactcttgtagattcatctctttagctgtgtcattttttcgacgcgt

SEQ ID NO: 274 - DNA, 316 bp, Artificial Sequence
  source: /note="Description of Artificial Sequence: Synthetic polynucleotide"
ccctacgctagcctgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaatttctactcttgtagatgaagagcgagctcttcttttttcgacgcgtgt

SEQ ID NO: 275 - DNA, 21 bp, Artificial Sequence
  source: /note="Description of Artificial Sequence: Synthetic primer"
acagtgcaggtcaggcacacc

SEQ ID NO: 276 - DNA, 21 bp, Artificial Sequence
  source: /note="Description of Artificial Sequence: Synthetic primer"
tctgagtgtatgatggcctgg

SEQ ID NO: 277 - DNA, 20 bp, Artificial Sequence
  source: /note="Description of Artificial Sequence: Synthetic primer"
ggtggggtcatcatacatgg

SEQ ID NO: 278 - DNA, 21 bp, Artificial Sequence
  source: /note="Description of Artificial Sequence: Synthetic primer"
ttcctgctccatgagggatcc

SEQ ID NO: 279 - DNA, 21 bp, Artificial Sequence
  source: /note="Description of Artificial Sequence: Synthetic primer"
atcaagagtgaccatccacgg

SEQ ID NO: 280 - DNA, 23 bp, Artificial Sequence
  source: /note="Description of Artificial Sequence: Synthetic primer"
tggctgtgcaaagtgctgcctgg

SEQ ID NO: 281 - DNA, 21 bp, Artificial Sequence
  source: /note="Description of Artificial Sequence: Synthetic primer"
cacatgatgtcaaaggccacc

SEQ ID NO: 282 - DNA, 21 bp, Artificial Sequence
  source: /note="Description of Artificial Sequence: Synthetic primer"
gtccatgccacactgatcagg

SEQ ID NO: 283 - DNA, 22 bp, Artificial Sequence
  source: /note="Description of Artificial Sequence: Synthetic primer"
accctgaggatggtgtctctgg

SEQ ID NO: 284 - DNA, 23 bp, Artificial Sequence
  source: /note="Description of Artificial Sequence: Synthetic primer"
ctggcactgactttgactattcc

SEQ ID NO: 285 - DNA, 21 bp, Artificial Sequence
  source: /note="Description of Artificial Sequence: Synthetic primer"
atatgatggaagaggtttagc

SEQ ID NO: 286 - DNA, 23 bp, Artificial Sequence
  source: /note="Description of Artificial Sequence: Synthetic primer"
ccgatgctaactgagttctaagc

SEQ ID NO: 287 - DNA, 20 bp, Artificial Sequence
  source: /note="Description of Artificial Sequence: Synthetic primer"
ggtctcatgtgtggcactca

SEQ ID NO: 288 - DNA, 20 bp, Artificial Sequence
  source: /note="Description of Artificial Sequence: Synthetic primer"
tgtccaaccttcaggcaagg

SEQ ID NO: 289 - DNA, 22 bp, Artificial Sequence
  source: /note="Description of Artificial Sequence: Synthetic primer"
tggctaagcctggccaagaacg

SEQ ID NO: 290 - DNA, 22 bp, Artificial Sequence
  source: /note="Description of Artificial Sequence: Synthetic primer"
tcaggatgaaggctgccttcgg

SEQ ID NO: 291 - DNA, 21 bp, Artificial Sequence
  source: /note="Description of Artificial Sequence: Synthetic primer"
gtaacgtcctggacactgtgg

SEQ ID NO: 292 - DNA, 21 bp, Artificial Sequence
  source: /note="Description of Artificial Sequence: Synthetic primer"
gggcaaggctggccaacccat

SEQ ID NO: 293 - DNA, 21 bp, Artificial Sequence
  source: /note="Description of Artificial Sequence: Synthetic primer"
ttggtccaataggtcatgacg

SEQ ID NO: 294 - protein, 1200 aa, Artificial Sequence
  source: /note="Description of Artificial Sequence: Synthetic consensus sequence"
  MOD_RES (7)..(7): Any amino acid
  MOD_RES (11)..(13): Any amino acid
  VARIANT (18)..(18): /replace="Leu"
  MOD_RES (20)..(21): Any amino acid
  MOD_RES (39)..(39): Any amino acid
  MOD_RES (75)..(75): Any amino acid
  MOD_RES (93)..(93): Any amino acid
  MOD_RES (100)..(100): Any amino acid
  MOD_RES (145)..(145): Any amino acid
  MOD_RES (149)..(149): Any amino acid
  MOD_RES (154)..(154): Any amino acid
  MOD_RES (216)..(216): Any amino acid
  MOD_RES (236)..(236): Any amino acid
  MOD_RES (278)..(278): Any amino acid
  MOD_RES (315)..(315): Any amino acid
  MOD_RES (317)..(317): Any amino acid
  MOD_RES (319)..(319): Any amino acid
  MOD_RES (370)..(370): Any amino acid
  MOD_RES (407)..(407): Any amino acid
  MOD_RES (419)..(419): Any amino acid
  MOD_RES (428)..(428): Any amino acid
  MOD_RES (445)..(445): Any amino acid
  MOD_RES (455)..(455): Any amino acid
  MOD_RES (563)..(563): Any amino acid
  MOD_RES (717)..(717): Any amino acid
  MOD_RES (795)..(796): Any amino acid
  MOD_RES (800)..(800): Any amino acid
  MOD_RES (942)..(942): Any amino acid
  VARIANT (971)..(971): /replace="Leu"
  MOD_RES (1045)..(1045): Any amino acid
  MOD_RES (1050)..(1050): Any amino acid
  MOD_RES (1063)..(1064): Any amino acid
  MOD_RES (1117)..(1118): Any amino acid
  MOD_RES (1132)..(1132): Any amino acid
  MOD_RES (1138)..(1138): Any amino acid
  MOD_RES (1194)..(1194): Any amino acid
  MOD_RES (1196)..(1196): Any amino acid
  MISC_FEATURE (1)..(1200): /note="Variant residues given in the sequence have no preference with respect to those in the annotations for variant positions"
MLFFMSXDITXXXNMMMIYXXFTNLYPLSKTLRFELKPXGKTLENIEKNGLLEKDEKRAEDYKKVKKIIDEYHKXFIEEALSSVKLSELEEYXDLYLKKXKDDKDKKALKKEQDKLRKEIVKAFKADEKYKKLFKKELILKDLPXFVKXEEDKXLLKSFKGFTTYFTGFHENRKNMYSDEDKSTAIAYRIIHENLPKFIDNIKIFEKIKEKAELLXZIELEEIFSLDYYNNVLTQXGIDKYNAIIGGISTEDGKIKGLNEYINLYNQQNKDKKKLPKXKPLYKQILSDRESLSFLPEKFEDDEEVLDAIKEFYDXIXEXILEKLKLLFDNLSEYDLSKIYIKNDALTTISQKVFGDWSVIGDALEEYYDXPKKKKEKYEEKRKKKLKKKKSFSLEELNELLEERIEXYFATLGDLIENXYLAAEKLLXTEYPEEKNLKKDKEAVXAIKDLLDSIXBLQHFLKPLLGKGDELDKDENFYGEFEELYEELDEIIPLYNKVRNYLTQKPYSTEKIKLNFENPTLLNGWDKNKEKDNLAIILRKDGKYYLGIMNKKHNKIFDNKPKXCYEKMVYKLLPGPNKMLPKVFFSKKNIKEYNPSEEILEIYKKGTHKKGDNFSLKDCHKLIDFFKESIEKHEDWKKFGFKFSDTESYNDISEFYREVEKQGYKLSFTKISESYIDSLVEEGKLYLFQIYNKDFSPYSKGKPNLHTLYWKALFSEXNLKDVVYKLNGEAEIFYRKASIKKKKITHKAGEPIKNKNNPKKESKFEYDIIKDKRYTEDKFFFHVPITMNFKASGNXXFNDXVNEYIRENDDVHIIGIDRGERNLLYYSVIDSKGNILEQDSLNIINNKTDYHDLLDEREKERDKARKNWQTIENIKELKEGYLSQVVHKIAKLMIKYNAIVVLEDLNFGFKRGRQKVEKQVYQKFEKMLIDKLNYLVDKDKEXDEIGGLLNAYQLTNPFESFKKLGKQTGFIFYVPAWNTSKIDPTTGFVNLFYPKYENVDKAKEFFSKFDSIRYNDKDYFEFAFDYKNFTKKAEGSRTKWTICTXGERIXNFRNSDKNNKWDXXEIDLTEELKELFKDYGINYGEDLKEAICSEDDKDFFKSLLYLLKLTLQMRNSXXDDYIISPVANDNGXFFDSRXAKLPKDADANGAYNIARKGLWLLEQIKNTDEGKKALISNKEWLEFAQNRPYLKDAXAXNKKH

SEQ ID NO: 295 - protein, 1300 aa, Francisella tularensis; identical to SEQ ID NO: 51

SEQ ID NO: 296 - protein, 1477 aa, Unknown; identical to SEQ ID NO: 68
  source: /note="Description of Unknown: Candidatus Peregrinibacteria bacterium sequence"

SEQ ID NO: 297 - protein, 1477 aa, Unknown; identical to SEQ ID NO: 68
  source: /note="Description of Unknown: Candidatus Peregrinibacteria bacterium sequence"

SEQ ID NO: 298 - protein, 1477 aa, Unknown; identical to SEQ ID NO: 68
  source: /note="Description of Unknown: Candidatus Peregrinibacteria bacterium sequence"

SEQ ID NO: 299 - protein, 1403 aa, Unknown; identical to SEQ ID NO: 69
  source: /note="Description of Unknown: Candidatus Falkowbacteria bacterium sequence"

SEQ ID NO: 300 - protein, 1403 aa, Unknown; identical to SEQ ID NO: 69
  source: /note="Description of Unknown: Candidatus Falkowbacteria bacterium sequence"

SEQ ID NO: 301 - protein, 1352 aa, Unknown; identical to SEQ ID NO: 71
  source: /note="Description of Unknown: Parcubacteria group bacterium sequence"

SEQ ID NO: 302 - protein, 1331 aa, Unknown; identical to SEQ ID NO: 73
  source: /note="Description of Unknown: Parcubacteria group bacterium sequence"

SEQ ID NO: 303 - protein, 1285 aa, Unknown; identical to SEQ ID NO: 83
  source: /note="Description of Unknown: Candidatus Roizmanbacteria bacterium sequence"

SEQ ID NO: 304 - protein, 1247 aa, Unknown; identical to SEQ ID NO: 101
  source: /note="Description of Unknown: uncultured bacterium sequence"

SEQ ID NO: 305 - protein, 1219 aa, Unknown
  source: /note="Description of Unknown: candidate division WS6 bacterium sequence"
MKNVFGGFTNLYSLTKTLRFELKPTSKTQKLMKRNNVIQTDEEIDKLYHDEMKPILDEIHRRFINDALAQKIFISASLDNFLKVVKNYKVESAKKNIKQNQVKLLQKEITIKTLGLRREVVSGFITVSKKWKDKYVGLGIKLKGDGYKVLTEQAVLDILKIEFPNKAKYIDKFRGFWTYFSGFNENRKNYYSEEDKATSIANRIVNENLSRYIDNIIAFEEILQKIPNLKKFKQDLDITSYNYYLNQAGIDKYNKIIGGYIVDKDKKIQGINEKVNLYTQQTKKKLPKLKFLFKQIGSERKGFGIFEIKEGKEWEQLGDLFKLQRTKINSNGREKGLFDSLRTMYREFFDEIKRDSNSQARYSLDKIYFNKASVNTISNSWFTNWNKFAELLNIKEDKKNGEKKIPEQISIEDIKDSLSIIPKENLEELFKLTNREKHDRTRFFGSNAWVTFLNIWQNEIEESFNKLEEKEKDFKKNAAIKFQKNNLVQKNYIKEVCDRMLAIERMAKYHLPKDSNLSREEDFYWIIDNLSEQREIYKYYNAFRNYISKKPYNKSKMKLNFENGNLLGGWSDGQERNKAGVILRNGNKYYLGVLINRGIFRTDKINNEIYRTGSSKWERLILSNLKFQTLAGKGFLGKHGVSYGNMNPEKSVPSLQKFIRENYLKKYPQLTEVSNTKFLSKKDFDAAIKEALKECFTMNFINIAENKLLEAEDKGDLYLFEITNKDFSGKKSKGYEKGKDNIHTIYWKYLFSESNCKSPIIGLNGGAEIFFREGQKDKLHTKLDKKGKKVFDAKRYSEDKLFFHVSITINYGKPKNIKFRDIINQLITSMNVNIIGIDRGEKHLLYYSVIDSNGIILKQGSLNKIRVGDKEVDFNKKLTERANEMKKARQSWEQIGNIKNFKEGYLSQAIHEIYQLMIKYNAIIVLEDLNTEFKAKRLSKVEKSVYKKFELKLARKLNHLILKDRNTNEIGGVLKAYQLTPTIGGGDVSKFEKAKQWGMMFYVRANYTSTTDPVTGWRKHLYISNFSNNSVIKSFFDPTNRDTGIEIFYSGKYRSWGFRYVQKETGKKWELFATKELERFKYNQTTKLCEKINLYDKFEELFKGIDKSADIYSQLCNVLDFRWKSLVYLWNLLNQIRNVDKNAEGNKNDFIQSPVYPFFDSRKTDGKTEPINGDANGALNIARKGLMLVERIKNNPEKYEQLIRDTEWDAWIQNFNKVN

SEQ ID NO: 306 - protein, 1295 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHRLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGNPQFEFNIEDCRKFIDFYKESISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKKSIPKKITHPAKEAIANKNKDNPKKESFFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEHNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSILNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 307 - protein, 1300 aa, Francisella tularensis; identical to SEQ ID NO: 81

SEQ ID NO: 308 - protein, 1300 aa, Francisella tularensis; identical to SEQ ID NO: 51

SEQ ID NO: 309 - protein, 1307 aa, Francisella tularensis; identical to SEQ ID NO: 78

SEQ ID NO: 310 - protein, 1323 aa, Prevotella disiens; identical to SEQ ID NO: 74

SEQ ID NO: 311 - protein, 1323 aa, Prevotella disiens; identical to SEQ ID NO: 74

SEQ ID NO: 312 - protein, 1246 aa, Porphyromonas macacae; identical to SEQ ID NO: 102

SEQ ID NO: 313 - protein, 1257 aa, Prevotella bryantii; identical to SEQ ID NO: 96

SEQ ID NO: 314 - protein, 1247 aa, Prevotella bryantii; identical to SEQ ID NO: 100

SEQ ID NO: 315 - protein, 1253 aa, Prevotella albensis; identical to SEQ ID NO: 97

SEQ ID NO: 316 - protein, 1262 aa, Unknown; identical to SEQ ID NO: 91
  source: /note="Description of Unknown: Bacteroidetes oral taxon 274 sequence"

SEQ ID NO: 317 - protein, 1264 aa, Prevotella brevis; identical to SEQ ID NO: 87

SEQ ID NO: 318 - protein, 1260 aa, Porphyromonas crevioricanis; identical to SEQ ID NO: 93

SEQ ID NO: 319 - protein, 1260 aa, Porphyromonas crevioricanis; identical to SEQ ID NO: 94

SEQ ID NO: 320 - protein, 1260 aa, Porphyromonas crevioricanis; identical to SEQ ID NO: 92

SEQ ID NO: 321 - protein, 1262 aa, Porphyromonas crevioricanis; identical to SEQ ID NO: 90

SEQ ID NO: 322 - protein, 1224 aa, Unknown; identical to SEQ ID NO: 111
  source: /note="Description of Unknown: Lachnospiraceae bacterium sequence"

SEQ ID NO: 323 - protein, 1318 aa, Flavobacterium branchiophilum; identical to SEQ ID NO: 75

SEQ ID NO: 324 - protein, 1273 aa, Flavobacterium sp.; identical to SEQ ID NO: 86

SEQ ID NO: 325 - protein, 1264 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTYFTGFHQNRANMYVDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYAWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 326 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEEYKTLYLKQEKDDKDKKAFDKEKENLRKQIANAFRNNEKFKTLFAKELIKNDLMSFACEEDKKNVKEFEAFTTADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTYFTGFHSNRQNIYSDFNQKQTDKKKRQPKFKQLYKQILSDRQSLSFIAEAFKNDTEILEAIEKFYVNELLHFSNEGKSTNVLDAIKNAVSNLESFNLTKIYFRSGTSLTDVSRKVFGEWSIINRALDNYYATTYPIKPREKSEKYEERKEKWLKQDFNVSLIQTAIDEYDNETVKGKNSGKVIVDYFAKFCDDKETDLIQKVNEGYIAVKDLLNTPYPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKENLYYLGIMDKRHNRIFRNVPKADKKDSCYEKMVYKLLPGANKMLPKVFFSQSRIQEFTPSAKLLENYENETHKKGDNFNLNHCHQLIDFFKDSINKHEDWKNFDFRFSATSTYADLSGFYHEVEHQGYKISFQSIADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHVPITMNFKAEGIFNMNQRVNQFLKANPDINIIGIDRGERHLLYYTLINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLKQAKDFFEKFDSIRLNSKADYFEFAFDFKNFTGKADGGRTKWTVCTTNEDRYAWNRALNNNRGSQEKYDITAELKSLFDGKVDYKSGKDLKQQIASQELADFFRTLMKYLSVTLSLRHNNGEKGETEQDYILSPVADSMGKFFDSRKAGDDMPKNADANGAYHIALKGLWCLEQISKTDDLKKVKLAISNKEWLEFMQTLKG

SEQ ID NO: 327 - protein, 1249 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 328 - protein, 1230 aa, Unknown; identical to SEQ ID NO: 108
  source: /note="Description of Unknown: Lachnospiraceae bacterium sequence"

SEQ ID NO: 329 - protein, 1206 aa, Unknown; identical to SEQ ID NO: 113
  source: /note="Description of Unknown: Lachnospiraceae bacterium sequence"

SEQ ID NO: 330 - protein, 1206 aa, Butyrivibrio sp.; identical to SEQ ID NO: 114

SEQ ID NO: 331 - protein, 1205 aa, Oribacterium sp.; identical to SEQ ID NO: 115

SEQ ID NO: 332 - protein, 1205 aa, Pseudobutyrivibrio ruminis; identical to SEQ ID NO: 116

SEQ ID NO: 333 - protein, 1231 aa, Butyrivibrio fibrisolvens; identical to SEQ ID NO: 107

SEQ ID NO: 334 - protein, 1206 aa, Unknown
  source: /note="Description of Unknown: Lachnospiraceae bacterium sequence"
MENYYDSLTRQYPVTKTIRQELKPVGKTLENIKNAEIIEADKQKKEAYVKVKELMDEFHKSIIEKSLVGIKLDGLSEFEKLYKIKTKTDEDKNRISELFYYMRKQIADALKNSRDYGYVDNKDLIEKILPERVKDENSLNALSCFKGFTTYFTDYYKNRKNIYSDEEKHSTVGYRCINENLLIFMSNIEVYQIYKKANIKNDNYDEETLDKTFMIESFNECLTQSGVEAYNSVVASIKTATNLYIQKNNKEENFVRVPKMKVLFKQILSDRTSLFDGLIIESDDELLDKLCSFSAEVDKFLPINIDRYIKTLMDSNNGTGIYVKNDSSLTTLSNYLTDSWSSIRNAFNENYDAKYTGKVNDKYEEKREKAYKSNDSFELNYIQNLLGINVIDKYIERINFDIKEICEAYKEMTKNCFEDHDKTKKLQKNIKAVASIKSYLDSLKNIERDIKLLNGTGLESRNEFFYGEQSTVLEEITKVDELYNITRNYLTKKPFSTEKMKLNFNNPQLLGGWDVNKERDCYGVILIKDNNYYLGIMDKSANKSFLNIKESKNENAYKKVNCKLLPGPNKMFPKVFFAKSNIDYYDPTHEIKKLYDKGTFKKGNSFNLEDCHKLIDFYKESIKKNDDWKNFNFNFSDTKDYEDISGFFREVEAQNYKITYTNVSCDFIESLVDEGKLYLFQIYNKDFSEYATGNLNLHTLYLKMLFDERNLKDLCIKMNGEAEVFYRPASILDEDKVVHKANQKITNKNTNSKKKESIFSYDIVKDKRYTVDKFFIHLPITLNYKEQNVSRFNDYIREILKKSKNIRVIGIDRGERNLLYVVVCDSDGSILYQRSINEIVSGSHKTDYHKLLDNKEKERLSSRRDWKTIENIKDLKAGYMSQVVNEIYNLILKYNAIVVLEDLNIGFKNGRKKVEKQVYQNFEKALIDKLNYLCIDKTREQLSPSSPGGVLNAYQLTAKFESFEKIGKQTGCIFYVPAYLTSQIDPTTGFVNLFYQKDTSKQGLQLFFRKFKKINFDKVASNFEFVFDYNDFTNKAEGTKTNWTISTQGTRIAKYRSDDANGKWISRTVHPTDIIKEALNREKINYNDGHDLIDEIVSIEKSAVLKEIYYGFKLTLQLRNSTLANEEEQEDYIISPVKNSSGNYFDSRITSKELPCDADANGAYNIARKGLWALEQIRNSENVSKVKLAISNKEWFEYTQNNIPSL

SEQ ID NO: 335 - protein, 1228 aa, Unknown; identical to SEQ ID NO: 109
  source: /note="Description of Unknown: Lachnospiraceae bacterium sequence"

SEQ ID NO: 336 - protein, 1373 aa, Moraxella bovoculi; identical to SEQ ID NO: 70

SEQ ID NO: 337 - protein, 1373 aa, Moraxella bovoculi; identical to SEQ ID NO: 70

SEQ ID NO: 338 - protein, 1264 aa, Moraxella caprae; identical to SEQ ID NO: 88

SEQ ID NO: 339 - protein, 1235 aa, Anaerovibriosp.; identical to SEQ ID NO: 105

SEQ ID NO: 340 - protein, 1154 aa, Proteocatellas phenisci; identical to SEQ ID NO: 117

SEQ ID NO: 341 - protein, 1282 aa, Eubacterium eligens; identical to SEQ ID NO: 84

SEQ ID NO: 342 - protein, 1282 aa, Eubacterium eligens; identical to SEQ ID NO: 85

SEQ ID NO: 343 - protein, 1305 aa, Eubacterium sp.; identical to SEQ ID NO: 79

SEQ ID NO: 344 - protein, 1259 aa, Synergistes jonesii; identical to SEQ ID NO: 95

SEQ ID NO: 345 - protein, 1238 aa, Unknown; identical to SEQ ID NO: 104
  source: /note="Description of Unknown: Candidatus Methanoplasma termitum sequence"

SEQ ID NO: 346 - protein, 1227 aa, Unknown; identical to SEQ ID NO: 110
  source: /note="Description of Unknown: Candidatus Methanomethylophilus alvus sequence"

SEQ ID NO: 347 - protein, 1334 aa, Succinivibrio dextrinosolvens; identical to SEQ ID NO: 72

SEQ ID NO: 348 - protein, 1307 aa, Acidaminococcus sp.; identical to SEQ ID NO: 77

SEQ ID NO: 349 - protein, 1310 aa, Helcococcus kunzii; identical to SEQ ID NO: 76

SEQ ID NO: 350 - protein, 1255 aa, Butyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISELMQRFLTTRITALTKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEKARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 351 - protein, 1219 aa, Unknown
  source: /note="Description of Unknown: Lachnospiraceae bacterium sequence"
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKLLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 352 - DNA, 10715 bp, Artificial Sequence
  source: /note="Description of Artificial Sequence: Synthetic polynucleotide"
gaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttcatcaaggaattggttctaagcttatagaagcaatgattaaggaagccaaaaaaaataatattgatgcaatatttgtcttaggtcatccaagttattatccaaaatttggttttaaaccagccacagaatatcagataaaatgtgaatatgatgtcccagcggatgtttttatggtactagatttgtcagctaaactagctagtttaaaaggacaaactgtctactatgccgatgagtttggcaaaattttttagatctacaaaattataaactaaataaagattcttataataactttatatataatcgaaatgtagagaattttataaggagtctttatcatgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataactaattcattcaagaatatattaccctgtcagtttagcgactattacctctttaataatttgcaggggaattattttagtaatagtaatatacacaagagttattgattatatggaaaattatatttagataacatggttaaatgattttatattctgtccttactcgatatatttgcataatatctatagtaatgcctcagatactacatactattcatctagccaaacaaaagggcgcgatgctcataaaagtatcgataaaggaatctatagtaccaaaaaagatgacctgatcggtatcgatgttattaaccataaatatggtttggttggtaaaattgatgtttttcataaagataagggcttacttgtggagagaaaaaggcaaatcaagactatctatgatggctataaatatcagctttatgcgcaatatttttgtctccaagagatgggctatgatgtcaaagccattaaattttattcgatggttgataataaatcatacccaatagctataccaacttcagctgagttagaaaagtttgaaaaacatattcaaacaatcaagcaatataatccaatggataactcatttaggcaaaatattgaaaagtgtaaattttgtatatatgcaaacttatgtgataaaacggacttgtagattatgtttagtaaaaatgatattgaatcaaagaatatagtttttgttaatatttttgatggagtgaaacttagtctatcattggggaatatagttataaaagataaagaaactgatgaggtgaaaactaagctttctgttcataaagttcttgcattgtttatcgtaggtaatatgacgatgacctcgcaacttttagagacctgtaagaaaaatgctatacagctagtttttatgaaaaatagctttagaccatatctatgttttggtgatattgctgaggctaattttttagctagatataagcaatatagtgtagttgagcaagatataagtttagcaaggatttttataacatcaaagatacgcaatcaacataacttagtcaaaagcctaagagataaaactccagagcagcaagagatagtcaaaaagaataaacagctaatagcagagttagaaaatacaacaagcctagcggagctaatgggtatagagggcaatgttgccaaaaatttcttcaaaggattctatggacatttagatagttggcaagggcgcaaacctagaataaaacaggatccatataatgttgttttagacttgggctatagtatgttgtttaattttgtagagtgttttttgcgactttttggctttgatttatacaagggcttttgtcatcagacttggtataagcgtaaatccctagtttgtgactttgttgagccatttagatgtatagtggataaccaagttagaaaatcatggaatctcgggcaattttctgtagaggattttggttgcaaaaatgagcagttttatataaaaaaagataaaacaaaagactactcaaaaatactttttgccgagattatcagctacaagctagagatatttgaatatgtaagagaattttatcgtgcctttatgcgaggcaaagaaattgcagagtatccaatattttgttatgaaactaggagggtgtatgttgatagtcagttatgattttagtaataataaagtacgtgcaaagtttgccaaatttctagaaagttatggtgtacgtttacaatattcggtatttgagctcaaatatagcaagagaatgttagacttgattttagctgagatagaaaataactatgtaccactatttacaaatgctgatagtgttttaatctttaatgctccagataaagatgtgataaaatatggttatgcgattcatagagaacaagaggttgtttttatagactaaaaattgcaaaccttagtctttatgttaaaataactactaagttcttagagatatttaaaaatatgactgttgttatatatcaaaatgctaaaaaaatcatagattttaggtctttttttgctgatttaggcaaaaacgggtctaagaactttaaataatttctactgttgtagatgagaagtcatttaataaggccactgttaaaagtctaagaactttaaataatttctactgttgtagatgctactattcctgtgccttcagataattcagtctaagaactttaaataatttctactgttgtagatgtctagagccttttgtattagtagccggtctaagaactttaaataatttctactgttgtagattagcgatttatgaaggtcatttttttgtctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcccctacgtgctgctgaagttgcccgcaacagagagtggaaccaaccggtgataccacgatactatgactgagagtcaacgccatgagcggcctcatttcttattctgagttacaacagtccgcaccgctgtccggtagctccttccggtgggcgcggggcatgactatcgtcgccgcacttatgactgtcttctttatcatgcaactcgtaggacaggtgccggcagcgcccaacagtcccccggccacggggcctgccaccatacccacgccgaaacaagcgccctgcaccattatgttccggatctgcatcgcaggatgctgctggctaccctgtggaacacctacatctgtattaacgaagcgctaaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacg

SEQ ID NO: 353 - DNA, 20 bp, Artificial Sequence
  source: /note="Description of Artificial Sequence: Synthetic oligonucleotide"
gccctgcaaggcggtttttt

SEQ ID NO: 354 - DNA, 32 bp, Artificial Sequence
  source: /note="Description of Artificial Sequence: Synthetic oligonucleotide"
catcaaggaattgagcttatagaagccatagc

SEQ ID NO: 355 - DNA, 29 bp, Artificial Sequence
  source: /note="Description of Artificial Sequence: Synthetic oligonucleotide"
tgatgctccaagtgatgcaatcatccaag

SEQ ID NO: 356 - DNA, 29 bp, Artificial Sequence
  source: /note="Description of Artificial Sequence: Synthetic oligonucleotide"
aaccatgtgaaccagccacataaaatgtg

SEQ ID NO: 357 - DNA, 48 bp, Artificial Sequence
  source: /note="Description of Artificial Sequence: Synthetic oligonucleotide"
atgtcaatttatcaagaataaatatagtttaagtaaaatgtcagtaaa

SEQ ID NO: 358 - DNA, 33 bp, Artificial Sequence
  source: /note="Description of Artificial Sequence: Synthetic oligonucleotide"
aggagatattaagttcggtttgtattagcgaag

SEQ ID NO: 359 - DNA, 31 bp, Artificial Sequence
  source: /note="Description of Artificial Sequence: Synthetic oligonucleotide"
tcgctaatacaaaccgaacttaatatctcct

SEQ ID NO: 360 - DNA, 35 bp, Artificial Sequence
  source: /note="Description of Artificial Sequence: Synthetic oligonucleotide"
taatactattattggtggtaaatttgtaaatggtg

SEQ ID NO: 361 - DNA, 26 bp, Artificial Sequence
  source: /note="Description of Artificial Sequence: Synthetic oligonucleotide"
tgaggagtgctactttgagctagcga

SEQ ID NO: 362 - DNA, 44 bp, Artificial Sequence
  source: /note="Description of Artificial Sequence: Synthetic oligonucleotide"
gattataaaaaccttaggattataaaatttaaagaaaaccttag

SEQ ID NO: 363 - DNA, 41 bp, Artificial Sequence
  source: /note="Description of Artificial Sequence: Synthetic oligonucleotide"
tatgttcatatgtgtggaatgattttctaagtatatcttca

SEQ ID NO: 364 - DNA, 40 bp, Artificial Sequence
  source: /note="Description of Artificial Sequence: Synthetic oligonucleotide"
tgaagatatacttagaaatcattccacacatatgaacata

SEQ ID NO: 365 - DNA, 25 bp, Artificial Sequence
  source: /note="Description of Artificial Sequence: Synthetic oligonucleotide"
ggtaaaggtgaggcagtatcgtaaa

SEQ ID NO: 366 - DNA, 26 bp, Artificial Sequence
  source: /note="Description of Artificial Sequence: Synthetic oligonucleotide"
ctgggggagtgcttagagcttatcag

SEQ ID NO: 367 - DNA, 24 bp, Artificial Sequence
  source: /note="Description of Artificial Sequence: Synthetic oligonucleotide"
tgccaatggttcatattgggtggg

SEQ ID NO: 368 - DNA, 35 bp, Artificial Sequence
  source: /note="Description of Artificial Sequence: Synthetic oligonucleotide"
ttagttattcactcaaaatacttagttaaaaatac

SEQ ID NO: 369 - DNA, 28 bp, Artificial Sequence
  source: /note="Description of Artificial Sequence: Synthetic oligonucleotide"
atttttgtctccaagagatgggctatga

SEQ ID NO: 370 - DNA, 28 bp, Artificial Sequence
  source: /note="Description of Artificial Sequence: Synthetic oligonucleotide"
taaaaacagaggttctctacccgatact

SEQ ID NO: 371 - DNA, 18 bp, Artificial Sequence
  source: /note="Description of Artificial Sequence: Synthetic oligonucleotide"
ggcaagggcacctagaag

SEQ ID NO: 372 - DNA, 29 bp, Artificial Sequence
  source: /note="Description of Artificial Sequence: Synthetic oligonucleotide"
ggttatgcgattcatagagaacaagaggt

SEQ ID NO: 373 - DNA, 29 bp, Artificial Sequence
  source: /note="Description of Artificial Sequence: Synthetic oligonucleotide"
agacaaaaaaatgaccttcataaatcgct

SEQ ID NO: 374 - DNA, 21 bp, Artificial Sequence
  source: /note="Description of Artificial Sequence: Synthetic oligonucleotide"
tcatacacggttgactgcgtt

SEQ ID NO: 375 - DNA, 3912 bp, Artificial Sequence
  source: /note="Description of Artificial Sequence: Synthetic polynucleotide"
  CDS (1)..(3909)
gccaccatgaacatcaaaaactttaccgggctctaccccctcagcaaaactttgcgctttgaactcaagcctattggcaaaaccaaggaaaacatcgagaaaaatggcatcctgaccaaggacgagcaacgggctaaagactacctcatagtcaaaggctttattgacgagtatcacaagcagttcatcaaagacaggctttgggactttaaattgcctctcgaaagtgagggggagaagaacagtctcgaagaataccaggaactgtacgagctcactaagcgcaacgatgcccaggaggccgacttcaccgagattaaagataaccttcgcagctctattaccgaacagctcacgaagtctggatctgcgtacgatcggatttttaaaaaagagttcattagagaagacctggtcaacttcctcgaagatgaaaaagataaaaatatcgtgaaacagttcgaggactttactacatattttacgggtttttatgaaaataggaagaacatgtactctagcgaagagaagtccacggccatcgcataccggcttatccatcagaatctgccaaaattcatggacaacatgagaagttttgccaaaattgcaaattccagtgtttccgagcactttagcgacatctatgaaagctggaaggaatatctgaatgtaaatagcatcgaggaaatcttccagctcgactattttagcgaaaccttgactcagccacatattgaggtgtataactatattatcgggaagaaagtcctggaagacggaaccgagataaagggcatcaacgagtatgtgaacctctacaatcagcagcagaaagataagagtaaacgactgcctttcctggtgccactgtataagcaaattttgtctgatagggaaaaactctcctggattgctgaagagttcgacagcgacaagaagatgctgagcgctatcaccgagtcttacaaccacctgcacaacgtgttgatgggtaacgagaacgaaagcctgcgaaatctgctgctgaatattaaggactataacctggagaaaattaatatcacaaacgacttgtctctcaccgaaatctcccagaatctttttggccgatatgatgtattcacaaatgggatcaaaaacaagctgagagtgttgactccaaggaagaaaaaggagacggacgaaaattttgaggaccgcattaacaaaatttttaagacccagaagtccttcagcatcgcttttctgaacaagctgcctcagcccgaaatggaggatgggaagccccggaacattgaggactatttcattacacagggggcgattaacaccaaatctatacagaaagaagatatcttcgcccaaattgagaatgcatacgaggatgcacaggtgttcctgcaaattaaggacaccgacaacaaacttagccagaacaagacggcggtggaaaagatcaaaactttgctggacgccttgaaggaactccagcacttcatcaaaccgctgctgggctctggggaggagaacgagaaagacgaactgttctacggttccttcctggccatctgggacgaactggacaccattacaccactttataacaaagtgagaaattggctgacccgaaaaccatattcaacagaaaaaatcaaattgaatttcgacaacgctcagctgctgggagggtgggatgtcaataaagaacacgactgtgcaggtatcttgttgcggaaaaacgatagctactatctcggaattatcaataagaaaaccaaccacatctttgatacggatattacgccatcagatggcgagtgctatgacaaaatcgactacaagctccttcccggggcgaacaaaatgcttccaaaggtgttttttagtaagtcccgaatcaaagagttcgagccatcagaggccataatcaattgctataagaaggggacacacaaaaaaggaaaaaactttaacctgacggactgtcaccgcctgatcaacttttttaagacctcaatcgagaaacacgaggattggtcaaaattcggattcaagttctccgataccgaaacgtatgaggatattagcggtttttatagagaggtcgagcagcagggatacaggctgacgagccatccagtcagtgccagctatatacatagtctggtcaaggaaggaaaactgtacctcttccaaatctggaacaaggacttttctcaattctccaaggggacccctaacttgcacactctctattggaagatgctgtttgacaaacggaatcttagcgatgtggtttataagctgaatggccaggctgaagtgttctatagaaagagctccattgaacaccagaaccgaattatccaccccgctcagcatcccatcacaaataagaatgagcttaacaaaaagcacactagcaccttcaaatacgatatcatcaaagatcgcagatacacggtggataaattccagttccatgtgcccattactataaattttaaggcgaccgggcagaacaacatcaacccaatcgtccaagaggtgattcgccaaaacggtatcacccacatcataggcatcgatcgaggtgaacgccatcttctgtacctctctctcatcgatttgaaaggcaacatcatcaagcagatgactctcaacgaaattattaatgagtataagggtgtgacctataagaccaactaccataacctcctggagaagagggagaaggagcggaccgaggccagacactcctggagtagtattgaaagcataaaagaactgaaggatggatacatgtcacaggtgattcacaaaattacggacatgatggttaagtacaatgcgattgtggtcctggaggacctcaacggggggtttatgcgaggccgccagaaggtcgagaagcaggtgtaccagaaatttgaaaaaaagttgatcgacaagctgaactatctcgttgacaagaaactcgacgctaacgaggtcggcggagtactgaatgcttatcagctgaccaacaagttcgagtctttcaagaagattgggaaacaaagcggatttttgttctacatccccgcctggaacacaagcaaaatcgatcctataacagggttcgttaatctgttcaacaccaggtacgagtctatcaaggagacaaaagttttttggtctaagtttgatattatccgatacaataaagagaagaattggttcgagttcgtcttcgattacaatacctttacgactaaagcggagggaacacgcactaagtggactctgtgcacccacggcactcgcatccagacattccggaacccagaaaagaatgcccagtgggacaataaagagatcaatttgactgagtccttcaaagctctgtttgaaaagtacaagatcgatatcaccagtaatctcaaggaatccatcatgcaggaaaccgagaagaagttcttccaggaactgcataatctgctccacctgaccctgcagatgaggaatagcgttactggaaccgacatagactatttgatcagccccgttgccgatgaggatggaaatttctatgatagtcgcataaatggcaaaaattttccggagaatgccgatgccaatggcgcgtacaacatcgcacgaaagggtctgatgcttattcggcagatcaagcaagcagatccacagaagaaattcaagtttgagacaatcaccaataaagactggctgaaattcgcccaagacaagccctatcttaaagatggcagcgggaaaaggccggcggccacgaaaaaggccggccaggcaaaaaagaaaaagggatcctacccatacgatgttccagattacgcttatccctacgacgtgcctgattatgcatacccatacgatgtccccgactatgcctaa

SEQ ID NO: 376 - protein, 1303 aa, Artificial Sequence
  source: /note="Description of Artificial Sequence: Synthetic polypeptide"
ATMNIKNFTGLYPLSKTLRFELKPIGKTKENIEKNGILTKDEQRAKDYLIVKGFIDEYHKQFIKDRLWDFKLPLESEGEKNSLEEYQELYELTKRNDAQEADFTEIKDNLRSSITEQLTKSGSAYDRIFKKEFIREDLVNFLEDEKDKNIVKQFEDFTTYFTGFYENRKNMYSSEEKSTAIAYRLIHQNLPKFMDNMRSFAKIANSSVSEHFSDIYESWKEYLNVNSIEEIFQLDYFSETLTQPHIEVYNYIIGKKVLEDGTEIKGINEYVNLYNQQQKDKSKRLPFLVPLYKQILSDREKLSWIAEEFDSDKKMLSAITESYNHLHNVLMGNENESLRNLLLNIKDYNLEKINITNDLSLTEISQNLFGRYDVFTNGIKNKLRVLTPRKKKETDENFEDRINKIFKTQKSFSIAFLNKLPQPEMEDGKPRNIEDYFITQGAINTKSIQKEDIFAQIENAYEDAQVFLQIKDTDNKLSQNKTAVEKIKTLLDALKELQHFIKPLLGSGEENEKDELFYGSFLAIWDELDTITPLYNKVRNWLTRKPYSTEKIKLNFDNAQLLGGWDVNKEHDCAGILLRKNDSYYLGIINKKTNHIFDTDITPSDGECYDKIDYKLLPGANKMLPKVFFSKSRIKEFEPSEAIINCYKKGTHKKGKNFNLTDCHRLINFFKTSIEKHEDWSKFGFKFSDTETYEDISGFYREVEQQGYRLTSHPVSASYIHSLVKEGKLYLFQIWNKDFSQFSKGTPNLHTLYWKMLFDKRNLSDVVYKLNGQAEVFYRKSSIEHQNRIIHPAQHPITNKNELNKKHTSTFKYDIIKDRRYTVDKFQFHVPITINFKATGQNNINPIVQEVIRQNGITHIIGIDRGERHLLYLSLIDLKGNIIKQMTLNEIINEYKGVTYKTNYHNLLEKREKERTEARHSWSSIESIKELKDGYMSQVIHKITDMMVKYNAIVVLEDLNGGFMRGRQKVEKQVYQKFEKKLIDKLNYLVDKKLDANEVGGVLNAYQLTNKFESFKKIGKQSGFLFYIPAWNTSKIDPITGFVNLFNTRYESIKETKVFWSKFDIIRYNKEKNWFEFVFDYNTFTTKAEGTRTKWTLCTHGTRIQTFRNPEKNAQWDNKEINLTESFKALFEKYKIDITSNLKESIMQETEKKFFQELHNLLHLTLQMRNSVTGTDIDYLISPVADEDGNFYDSRINGKNFPENADANGAYNIARKGLMLIRQIKQADPQKKFKFETITNKDWLKFAQDKPYLKDGSGKRPAATKKAGQAKKKKGSYPYDVPDYAYPYDVPDYAYPYDVPDYA

SEQ ID NO: 377 - DNA, 112 bp, Artificial Sequence
  source: /note="Description of Artificial Sequence: Synthetic polynucleotide"
  modified_base (30)..(37): a, c, t, g, unknown or other
ggccagtgaattcgagctcggtacccgggnnnnnnnngagaagtcatttaataaggccactgttaaaaagcttggcgtaatcatggtcatagctgtttcctgtgtgaaattg

SEQ ID NO: 378 - DNA, 112 bp, Artificial Sequence
  source: /note="Description of Artificial Sequence: Synthetic polynucleotide"
  modified_base (61)..(68): a, c, t, g, unknown or other
ggccagtgaattcgagctcggtacccggggagaagtcatttaataaggccactgttaaaannnnnnnnagcttggcgtaatcatggtcatagctgtttcctgtgtgaaattg

SEQ ID NO: 379 - DNA, 21 bp, Artificial Sequence
  source: /note="Description of Artificial Sequence: Synthetic oligonucleotide"
ggccagtgaattcgagctcgg

SEQ ID NO: 380 - DNA, 28 bp, Artificial Sequence
  source: /note="Description of Artificial Sequence: Synthetic oligonucleotide"
caatttcacacaggaaacagctatgacc

SEQ ID NO: 381 - RNA, 81 nt, Artificial Sequence
  source: /note="Description of Artificial Sequence: Synthetic oligonucleotide"
aaguucuuagagauauuuaaaaauaugacuguuguuauauaucaaaaugcuaaaaaaaucauagauuuuaggucuuuuuuu

SEQ ID NO: 382 - DNA, 111 bp, Artificial Sequence
  source: /note="Description of Artificial Sequence: Synthetic polynucleotide"
aattttttagatctacaaaattataaactaaataaagattcttataataactttatatataatcgaaatgtagagaattttataaggagtctttatcatgtcaatttatca

SEQ ID NO: 383 - DNA, 77 bp, Artificial Sequence
  source: /note="Description of Artificial Sequence: Synthetic oligonucleotide"
aaaattataaactaaataaagattcttataataactttatatataatcgaaatgtagagaattttataaggagtctt

SEQ ID NO: 384 - DNA, 77 bp, Artificial Sequence; identical to SEQ ID NO: 383
  source: /note="Description of Artificial Sequence: Synthetic oligonucleotide"

SEQ ID NO: 385 - DNA, 77 bp, Artificial Sequence; identical to SEQ ID NO: 383
  source: /note="Description of Artificial Sequence: Synthetic oligonucleotide"

SEQ ID NO: 386 - DNA, 77 bp, Artificial Sequence
  source: /note="Description of Artificial Sequence: Synthetic oligonucleotide"
aaattataaactaaataaagattcttataataactttatatataatcgaaatgtagagaattttataaggagtcttt

SEQ ID NO: 387 - DNA, 14 bp, Artificial Sequence
  source: /note="Description of Artificial Sequence: Synthetic oligonucleotide"
aattttttagatct

SEQ ID NO: 388 - RNA, 77 nt, Artificial Sequence
  source: /note="Description of Artificial Sequence: Synthetic oligonucleotide"
aaaauuauaaacuaaauaaagauucuuauaauaacuuuauauauaaucgaauguagagaaauuuuauaaggagucuu

SEQ ID NO: 389 - DNA, 77 bp, Artificial Sequence
  source: /note="Description of Artificial Sequence: Synthetic oligonucleotide"
actttaaataatttctactgttgtagatgagaagtcatttaataaggccactgttaaaagtctaagaactttaaata

SEQ ID NO: 390 - DNA, 77 bp, Artificial Sequence
  source: /note="Description of Artificial Sequence: Synthetic oligonucleotide"
ctactattcctgtgccttcagataattcagtctaagaactttaaataatttctactgttgtagatgtctagagcctt

SEQ ID NO: 391 - DNA, 103 bp, Artificial Sequence
  source: /note="Description of Artificial Sequence: Synthetic polynucleotide"
gtctaagaactttaaataatttctactgttgtagatgagaagtcatttaataaggccactgttaaaagtctaagaactttaaataatttctactgttgtagat

SEQ ID NO: 392 - DNA, 149 bp, Artificial Sequence
  source: /note="Description of Artificial Sequence: Synthetic polynucleotide"
ctgatttaggcaaaaacgggtctaagaactttaaataatttctactgttgtagatgagaagtcatttaataaggccactgttaaaagtctaagaactttaaataatttctactgttgtagatgctactattcctgtgccttcagataat

SEQ ID NO: 393 - RNA, 28 nt, Artificial Sequence
  source: /note="Description of Artificial Sequence: Synthetic oligonucleotide"
acuuuaaauaauuucuacuguuguagau

SEQ ID NO: 394 - RNA, 35 nt, Artificial Sequence
  source: /note="Description of Artificial Sequence: Synthetic oligonucleotide"
gagaagucauuuaauaaggccacuguuaaaaagcu

SEQ ID NO: 395 - RNA, 17 nt, Artificial Sequence
  source: /note="Description of Artificial Sequence: Synthetic oligonucleotide"
gucuaagaacuuuaaau

SEQ ID NO: 396 - RNA, 28 nt, Artificial Sequence
  source: /note="Description of Artificial Sequence: Synthetic oligonucleotide"
acuuuaaauaauuucuacuguuguagau

SEQ ID NO: 397 - RNA, 31 nt, Artificial Sequence
  source: /note="Description of Artificial Sequence: Synthetic oligonucleotide"
gagaagucauuuaauaaggccacuguuaaaa

SEQ ID NO: 398 - RNA, 17 nt, Artificial Sequence
  source: /note="Description of Artificial Sequence: Synthetic oligonucleotide"
gucuaagaacuuuaaau

SEQ ID NO: 399 - RNA, 28 nt, Artificial Sequence
  source: /note="Description of Artificial Sequence: Synthetic oligonucleotide"
acuuuaaauaauuucuacuguuguagau

SEQ ID NO: 400 - RNA, 30 nt, Artificial Sequence
  source: /note="Description of Artificial Sequence: Synthetic oligonucleotide"
gagaagucauuuaauaaggccacuguuaaa

SEQ ID NO: 401 - RNA, 17 nt, Artificial Sequence
  source: /note="Description of Artificial Sequence: Synthetic oligonucleotide"
gucuaagaacuuuaaau

SEQ ID NO: 402 - RNA, 28 nt, Artificial Sequence
  source: /note="Description of Artificial Sequence: Synthetic oligonucleotide"
acuuuaaauaauuucuacuguuguagau

SEQ ID NO: 403 - RNA, 27 nt, Artificial Sequence
  source: /note="Description of Artificial Sequence: Synthetic oligonucleotide"
gagaagucauuuaauaaggccacuguu

SEQ ID NO: 404 - RNA, 17 nt, Artificial Sequence
  source: /note="Description of Artificial Sequence: Synthetic oligonucleotide"
gucuaagaacuuuaaau

SEQ ID NO: 405 - RNA, 28 nt, Artificial Sequence
  source: /note="Description of Artificial Sequence: Synthetic oligonucleotide"
acuuuaaauaauuucuacuguuguagau

SEQ ID NO: 406 - RNA, 24 nt, Artificial Sequence
  source: /note="Description of Artificial Sequence: Synthetic oligonucleotide"
gagaagucauuuaauaaggccacu

SEQ ID NO: 407 - RNA, 17 nt, Artificial Sequence
  source: /note="Description of Artificial Sequence: Synthetic oligonucleotide"
gucuaagaacuuuaaau

SEQ ID NO: 408 - RNA, 28 nt, Artificial Sequence
  source: /note="Description of Artificial Sequence: Synthetic oligonucleotide"
acuuuaaauaauuucuacuguuguagau

SEQ ID NO: 409 - RNA, 20 nt, Artificial Sequence
  source: /note="Description of Artificial Sequence: Synthetic oligonucleotide"
gagaagucauuuaauaaggc

SEQ ID NO: 410 - RNA, 17 nt, Artificial Sequence
  source: /note="Description of Artificial Sequence: Synthetic oligonucleotide"
gucuaagaacuuuaaau

SEQ ID NO: 411 - RNA, 28 nt, Artificial Sequence
  source: /note="Description of Artificial Sequence: Synthetic oligonucleotide"
acuuuaaauaauuucuacuguuguagau

SEQ ID NO: 412 - RNA, 17 nt, Artificial Sequence
  source: /note="Description of Artificial Sequence: Synthetic oligonucleotide"
gagaagucauuuaauaa

SEQ ID NO: 413 - RNA, 17 nt, Artificial Sequence
  source: /note="Description of Artificial Sequence: Synthetic oligonucleotide"
gucuaagaacuuuaaau

SEQ ID NO: 414 - RNA, 28 nt, Artificial Sequence
  source: /note="Description of Artificial Sequence: Synthetic oligonucleotide"
acuuuaaauaauuucuacuguuguagau

SEQ ID NO: 415 - RNA, 14 nt, Artificial Sequence
  source: /note="Description of Artificial Sequence: Synthetic oligonucleotide"
gagaagucauuuaa

SEQ ID NO: 416 - RNA, 17 nt, Artificial Sequence
  source: /note="Description of Artificial Sequence: Synthetic oligonucleotide"
gucuaagaacuuuaaau

SEQ ID NO: 417 - RNA, 28 nt, Artificial Sequence
  source: /note="Description of Artificial Sequence: Synthetic oligonucleotide"
acuuuaaauaauuucuacuguuguagau

SEQ ID NO: 418 - RNA, 27 nt, Artificial Sequence
  source: /note="Description of Artificial Sequence: Synthetic oligonucleotide"
agucauuuaauaaggccacuguuaaaa

SEQ ID NO: 419 - RNA, 17 nt, Artificial Sequence
  source: /note="Description of Artificial Sequence: Synthetic oligonucleotide"
gucuaagaacuuuaaau

SEQ ID NO: 420 - RNA, 28 nt, Artificial Sequence
  source: /note="Description of Artificial Sequence: Synthetic oligonucleotide"
acuuuaaauaauuucuacuguuguagau

SEQ ID NO: 421 - RNA, 24 nt, Artificial Sequence
  source: /note="Description of Artificial Sequence: Synthetic oligonucleotide"
cauuuaauaaggccacuguuaaaa

SEQ ID NO: 422 - RNA, 17 nt, Artificial Sequence
  source: /note="Description of Artificial Sequence: Synthetic oligonucleotide"
gucuaagaacuuuaaau

SEQ ID NO: 423 - RNA, 28 nt, Artificial Sequence
  source: /note="Description of Artificial Sequence: Synthetic oligonucleotide"
acuuuaaauaauuucuacuguuguagau

SEQ ID NO: 424 - RNA, 20 nt, Artificial Sequence
  source: /note="Description of Artificial Sequence: Synthetic oligonucleotide"
uaauaaggccacuguuaaaa

SEQ ID NO: 425 - RNA, 17 nt, Artificial Sequence
  source: /note="Description of Artificial Sequence: Synthetic oligonucleotide"
gucuaagaacuuuaaau

SEQ ID NO: 426 - RNA, 28 nt, Artificial Sequence
  source: /note="Description of Artificial Sequence: Synthetic oligonucleotide"
acuuuaaauaauuucuacuguuguagau

SEQ ID NO: 427 - RNA, 17 nt, Artificial Sequence
  source: /note="Description of Artificial Sequence: Synthetic oligonucleotide"
uaaggccacuguuaaaa

SEQ ID NO: 428 - RNA, 17 nt, Artificial Sequence
  source: /note="Description of Artificial Sequence: Synthetic oligonucleotide"
gucuaagaacuuuaaau

SEQ ID NO: 429 - RNA, 28 nt, Artificial Sequence
  source: /note="Description of Artificial Sequence: Synthetic oligonucleotide"
acuuuaaauaauuucuacuguuguagau

SEQ ID NO: 430 - RNA, 14 nt, Artificial Sequence
  source: /note="Description of Artificial Sequence: Synthetic oligonucleotide"
ggccacuguuaaaa

SEQ ID NO: 431 - RNA, 17 nt, Artificial Sequence
  source: /note="Description of Artificial Sequence: Synthetic oligonucleotide"
gucuaagaacuuuaaau

SEQ ID NO: 432 - DNA, 103 bp, Artificial Sequence; identical to SEQ ID NO: 391
  source: /note="Description of Artificial Sequence: Synthetic polynucleotide"

SEQ ID NO: 433 - DNA, 3849 bp, Artificial Sequence
  source: /note="Description of Artificial Sequence: Synthetic polynucleotide"
ggtaccatggattacggcaacggccagtttgagcggagagcccccctgaccaagacaatcaccctgcgcctgaagcctatcggcgagacacgggagacaatccgcgagcagaagctgctggagcaggacgccgccttcagaaagctggtggagacagtgacccctatcgtggacgattgtatcaggaagatcgccgataacgccctgtgccactttggcaccgagtatgacttcagctgtctgggcaacgccatctctaagaatgacagcaaggccatcaagaaggagacagagaaggtggagaagctgctggccaaggtgctgaccgagaatctgccagatggcctgcgcaaggtgaacgacatcaattccgccgcctttatccaggatacactgacctctttcgtgcaggacgatgccgacaagcgggtgctgatccaggagctgaagggcaagaccgtgctgatgcagcggttcctgaccacacggatcacagccctgaccgtgtggctgcccgacagagtgttcgagaactttaatatcttcatcgagaacgccgagaagatgagaatcctgctggactcccctctgaatgagaagatcatgaagtttgacccagatgccgagcagtacgcctctctggagttctatggccagtgcctgtctcagaaggacatcgatagctacaacctgatcatctccggcatctatgccgacgatgaggtgaagaaccctggcatcaatgagatcgtgaaggagtacaatcagcagatccggggcgacaaggatgagtccccactgcccaagctgaagaagctgcacaagcagatcctgatgccagtggagaaggccttctttgtgcgcgtgctgtctaacgacagcgatgcccggagcatcctggagaagatcctgaaggacacagagatgctgccctccaagatcatcgaggccatgaaggaggcagatgcaggcgacatcgccgtgtacggcagccggctgcacgagctgagccacgtgatctacggcgatcacggcaagctgtcccagatcatctatgacaaggagtccaagaggatctctgagctgatggagacactgtctccaaaggagcgcaaggagagcaagaagcggctggagggcctggaggagcacatcagaaagtctacatacaccttcgacgagctgaacaggtatgccgagaagaatgtgatggcagcatacatcgcagcagtggaggagtcttgtgccgagatcatgagaaaggagaaggatctgaggaccctgctgagcaaggaggacgtgaagatccggggcaacagacacaatacactgatcgtgaagaactactttaatgcctggaccgtgttccggaacctgatcagaatcctgaggcgcaagtccgaggccgagatcgactctgacttctacgatgtgctggacgattccgtggaggtgctgtctctgacatacaagggcgagaatctgtgccgcagctatatcaccaagaagatcggctccgacctgaagcccgagatcgccacatacggcagcgccctgaggcctaacagccgctggtggtccccaggagagaagtttaatgtgaagttccacaccatcgtgcggagagatggccggctgtactatttcatcctgcccaagggcgccaagcctgtggagctggaggacatggatggcgacatcgagtgtctgcagatgagaaagatccctaacccaacaatctttctgcccaagctggtgttcaaggaccctgaggccttctttagggataatccagaggccgacgagttcgtgtttctgagcggcatgaaggcccccgtgacaatcaccagagagacatacgaggcctacaggtataagctgtataccgtgggcaagctgcgcgatggcgaggtgtccgaagaggagtacaagcgggccctgctgcaggtgctgaccgcctacaaggagtttctggagaacagaatgatctatgccgacctgaatttcggctttaaggatctggaggagtataaggacagctccgagtttatcaagcaggtggagacacacaacaccttcatgtgctgggccaaggtgtctagctcccagctggacgatctggtgaagtctggcaacggcctgctgttcgagatctggagcgagcgcctggagtcctactataagtacggcaatgagaaggtgctgcggggctatgagggcgtgctgctgagcatcctgaaggatgagaacctggtgtccatgcggaccctgctgaacagccggcccatgctggtgtaccggccaaaggagtctagcaagcctatggtggtgcaccgggatggcagcagagtggtggacaggtttgataaggacggcaagtacatcccccctgaggtgcacgacgagctgtatcgcttctttaacaatctgctgatcaaggagaagctgggcgagaaggcccggaagatcctggacaacaagaaggtgaaggtgaaggtgctggagagcgagagagtgaagtggtccaagttctacgatgagcagtttgccgtgaccttcagcgtgaagaagaacgccgattgtctggacaccacaaaggacctgaatgccgaagtgatggagcagtatagcgagtccaacagactgatcctgatcaggaataccacagatatcctgtactatctggtgctggacaagaatggcaaggtgctgaagcagagatccctgaacatcatcaatgacggcgccagggatgtggactggaaggagaggttccgccaggtgacaaaggatagaaacgagggctacaatgagtgggattattccaggacctctaacgacctgaaggaggtgtacctgaattatgccctgaaggagatcgccgaggccgtgatcgagtacaacgccatcctgatcatcgagaagatgtctaatgcctttaaggacaagtatagcttcctggacgacgtgaccttcaagggcttcgagacaaagctgctggccaagctgagcgatctgcactttaggggcatcaaggacggcgagccatgttccttcacaaaccccctgcagctgtgccagaacgattctaataagatcctgcaggacggcgtgatctttatggtgccaaattctatgacacggagcctggaccccgacaccggcttcatctttgccatcaacgaccacaatatcaggaccaagaaggccaagctgaactttctgagcaagttcgatcagctgaaggtgtcctctgagggctgcctgatcatgaagtacagcggcgattccctgcctacacacaacaccgacaatcgcgtgtggaactgctgttgcaatcacccaatcacaaactatgaccgggagacaaagaaggtggagttcatcgaggagcccgtggaggagctgtcccgcgtgctggaggagaatggcatcgagacagacaccgagctgaacaagctgaatgagcgggagaacgtgcctggcaaggtggtggatgccatctactctctggtgctgaattatctgcgcggcacagtgagcggagtggcaggacagagggccgtgtactatagccctgtgaccggcaagaagtacgatatctcctttatccaggccatgaacctgaataggaagtgtgactactataggatcggctccaaggagaggggagagtggaccgatttcgtggcccagctgatcaacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 434 - protein, 1233 aa, Artificial Sequence; identical to SEQ ID NO: 106
  source: /note="Description of Artificial Sequence: Synthetic polypeptide"

SEQ ID NO: 435 - DNA, 3873 bp, Artificial Sequence
  source: /note="Description of Artificial Sequence: Synthetic polynucleotide"
ggtaccatgctgctgtatgagaactacaccaagcggaatcagatcacaaagagcctgaggctggagctgcgccctcagggcaagaccctgagaaacatcaaggagctgaatctgctggagcaggacaaggccatctacgccctgctggagcggctgaagccagtgatcgatgagggcatcaaggacatcgccagagataccctgaagaactgcgagctgtcttttgagaagctgtacgagcacttcctgagcggcgacaagaaggcctatgccaaggagtccgagcggctgaagaaggagatcgtgaaaaccctgatcaagaacctgcccgagggcatcggcaagatctctgagatcaacagcgccaagtatctgaatggcgtgctgtacgacttcatcgataagacacacaaggactctgaggagaagcagaatatcctgagcgatatcctggagacaaagggctacctggccctgttctccaagtttctgacatctcggatcaccacactggagcagtccatgcctaagagagtgatcgagaacttcgagatctatgccgccaatatcccaaagatgcaggacgccctggagaggggagccgtgtcttttgccatcgagtacgagagcatctgttccgtggattactataaccagatcctgtcccaggaggacatcgattcttataatcgcctgatcagcggcatcatggacgaggatggcgccaaggagaagggcatcaaccagaccatctccgagaagaatatcaagatcaagtctgagcacctggaggagaagcccttcagaatcctgaagcagctgcacaagcagatcctggaggagcgcgagaaggcctttacaatcgaccacatcgacagcgatgaggaggtggtgcaggtgaccaaggaggccttcgagcagacaaaggagcagtgggagaacatcaagaagatcaatggcttctacgccaaggaccccggcgatatcaccctgtttatcgtggtgggccctaaccagacacacgtgctgtcccagctgatctacggcgagcacgaccggatcagactgctgctggaggagtatgagaagaacaccctggaggtgctgccccggagaacaaagtctgagaaggccagatacgataagttcgtgaatgccgtgcctaagaaggtggccaaggagagccacaccttcgacggcctgcagaagatgacaggcgacgatcggctgtttatcctgtatagagatgagctggcccggaactacatgagaatcaaggaggcctatggcacctttgagcgggacatcctgaagagcaggcgcggcatcaagggcaatcgggacgtgcaggagtctctggtgagcttttacgatgagctgacaaagttcaggagcgccctgcgcatcatcaattccggcaacgacgagaaggccgatccaatcttctataacacctttgatggcatcttcgagaaggccaataggacatacaaggccgagaatctgtgccgcaactatgtgaccaagtctccagccgacgatgccaggatcatggccagctgtctgggcaccccagcaaggctgcgcacacactggtggaatggcgaggagaacttcgccatcaatgacgtggccatgatccggagaggcgatgagtactattactttgtgctgaccccagacgtgaagcccgtggacctgaaaaccaaggacgagacagatgcccagatcttcgtgcagcgcaagggcgccaagtcctttctgggcctgccaaaggccctgttcaagtgcatcctggagccttactttgagtccccagagcacaagaatgacaagaactgcgtgatcgaggagtacgtgtctaagcccctgaccatcgacaggcgcgcctatgatatctttaagaacggcaccttcaagaaaaccaatatcggcatcgacggcctgaccgaggagaagttcaaggacgattgccgctatctgatcgacgtgtataaggagttcatcgccgtgtatacaaggtacagctgttttaacatgtccggcctgaagcgcgccgacgagtacaatgatatcggcgagttcttttctgacgtggataccaggctgtgcacaatggagtggattcccgtgagcttcgagcgcatcaacgacatggtggataagaaggagggcctgctgtttctggtgaggagcatgttcctgtataaccggcccagaaagccttatgagcgcacctttatccagctgttcagcgactccaacatggagcacacatctatgctgctgaatagcagggccatgatccagtacagggcagcctccctgccacggagagtgacccacaagaagggcagcatcctggtggccctgcgggattccaacggcgagcacatccccatgcacatcagagaggccatctacaagatgaagaacaattttgacatcagctccgaggatttcatcatggccaaggcctatctggccgagcacgacgtggccatcaagaaggccaacgaggatatcatcaggaataggcgctacaccgaggacaagttctttctgtctctgagctataccaagaacgccgatatcagcgcccgcacactggactacatcaatgataaggtggaggaggacacacaggattccaggatggccgtgatcgtgacccgcaacctgaaggacctgacatacgtggccgtggtggatgagaagaacaatgtgctggaggagaagagcctgaacgagatcgacggcgtgaattatcgggagctgctgaaggagagaaccaagatcaagtaccacgacaagacacggctgtggcagtatgacgtgagcagcaagggcctgaaggaggcctacgtggagctggccgtgacccagatctccaagctggccacaaagtataacgccgtggtggtggtggagtccatgtcctctaccttcaaggacaagttctcttttctggatgagcagatcttcaaggcctttgaggcccggctgtgcgccagaatgtccgacctgtcttttaatacaatcaaggagggcgaggccggctccatctctaaccccatccaggtgtccaacaataacggcaattcttatcaggacggcgtgatctacttcctgaataacgcctatacccggaccctgtgccctgataccggctttgtggacgtgttcgataagacccggctgatcacaatgcagtctaagagacagttctttgccaagatgaaggacatcagaatcgacgatggcgagatgctgttcacctttaacctggaggagtaccctacaaagaggctgctggaccgcaaggagtggaccgtgaagatcgccggcgatggctcctatttcgacaaggataagggcgagtacgtgtacgtgaacgacatcgtgagagagcagatcatcccagccctgctggaggacaaggccgtgttcgatggcaatatggccgagaagtttctggataagaccgccatcagcggcaagtccgtggagctgatctacaagtggttcgccaacgccctgtatggcatcatcacaaagaaggacggcgagaagatctaccggagccccatcaccggcacagagatcgacgtgagcaagaacaccacatacaacttcggcaagaagttcatgttcaagcaggagtatagaggcgacggcgattttctggacgccttcctgaattacatgcaggcccaggatatcgccgtgaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 436 - protein, 1241 aa, Artificial Sequence; identical to SEQ ID NO: 103
  source: /note="Description of Artificial Sequence: Synthetic polypeptide"

SEQ ID NO: 437 - DNA, 4581 bp, Artificial Sequence
  source: /note="Description of Artificial Sequence: Synthetic polynucleotide"
ggtaccatgtccaacttctttaagaatttcaccaacctgtatgagctgtccaagacactgaggtttgagctgaagcccgtgggcgacaccctgacaaacatgaaggaccacctggagtacgatgagaagctgcagaccttcctgaaggatcagaatatcgacgatgcctatcaggccctgaagcctcagttcgacgagatccacgaggagtttatcacagattctctggagagcaagaaggccaaggagatcgacttctccgagtacctggatctgtttcaggagaagaaggagctgaacgactctgagaagaagctgcgcaacaagatcggcgagacattcaacaaggccggcgagaagtggaagaaggagaagtaccctcagtatgagtggaagaagggctccaagatcgccaatggcgccgacatcctgtcttgccaggatatgctgcagtttatcaagtataagaacccagaggatgagaagatcaagaattacatcgacgatacactgaagggcttctttacctatttcggcggctttaatcagaacagggccaactactatgagacaaagaaggaggcctccaccgcagtggcaacaaggatcgtgcacgagaacctgccaaagttctgtgacaatgtgatccagtttaagcacatcatcaagcggaagaaggatggcaccgtggagaaaaccgagagaaagaccgagtacctgaacgcctaccagtatctgaagaacaataacaagatcacacagatcaaggacgccgagacagagaagatgatcgagtctacacccatcgccgagaagatcttcgacgtgtactacttcagcagctgcctgagccagaagcagatcgaggagtacaaccggatcatcggccactataatctgctgatcaacctgtataaccaggccaagagatctgagggcaagcacctgagcgccaacgagaagaagtataaggacctgcctaagttcaagaccctgtataagcagatcggctgcggcaagaagaaggacctgttttacacaatcaagtgtgataccgaggaggaggccaataagtcccggaacgagggcaaggagtcccactctgtggaggagatcatcaacaaggcccaggaggccatcaataagtacttcaagtctaataacgactgtgagaatatcaacaccgtgcccgacttcatcaactatatcctgacaaaggagaattacgagggcgtgtattggagcaaggccgccatgaacaccatctccgacaagtacttcgccaattatcacgacctgcaggatagactgaaggaggccaaggtgtttcagaaggccgataagaagtccgaggacgatatcaagatcccagaggccatcgagctgtctggcctgttcggcgtgctggacagcctggccgattggcagaccacactgtttaagtctagcatcctgagcaacgaggacaagctgaagatcatcacagattcccagaccccctctgaggccctgctgaagatgatcttcaatgacatcgagaagaacatggagtcctttctgaaggagacaaacgatatcatcaccctgaagaagtataagggcaataaggagggcaccgagaagatcaagcagtggttcgactatacactggccatcaaccggatgctgaagtactttctggtgaaggagaataagatcaagggcaactccctggataccaatatctctgaggccctgaaaaccctgatctacagcgacgatgccgagtggttcaagtggtacgacgccctgagaaactatctgacccagaagcctcaggatgaggccaaggagaataagctgaagctgaatttcgacaacccatctctggccggcggctgggatgtgaacaaggagtgcagcaatttttgcgtgatcctgaaggacaagaacgagaagaagtacctggccatcatgaagaagggcgagaataccctgttccagaaggagtggacagagggccggggcaagaacctgacaaagaagtctaatccactgttcgagatcaataactgcgagatcctgagcaagatggagtatgacttttgggccgacgtgagcaagatgatccccaagtgtagcacccagctgaaggccgtggtgaaccacttcaagcagtccgacaatgagttcatctttcctatcggctacaaggtgacaagcggcgagaagtttagggaggagtgcaagatctccaagcaggacttcgagctgaataacaaggtgtttaataagaacgagctgagcgtgaccgccatgcgctacgatctgtcctctacacaggagaagcagtatatcaaggccttccagaaggagtactgggagctgctgtttaagcaggagaagcgggacaccaagctgacaaataacgagatcttcaacgagtggatcaatttttgcaacaagaagtatagcgagctgctgtcctgggagagaaagtacaaggatgccctgaccaattggatcaacttctgtaagtactttctgagcaagtatcccaagaccacactgttcaactactcttttaaggagagcgagaattataactccctggacgagttctaccgggacgtggatatctgttcttacaagctgaatatcaacaccacaatcaataagagcatcctggatagactggtggaggagggcaagctgtacctgtttgagatcaagaatcaggacagcaacgatggcaagtccatcggccacaagaataacctgcacaccatctactggaacgccatcttcgagaattttgacaacaggcctaagctgaatggcgaggccgagatcttctatcgcaaggccatctccaaggataagctgggcatcgtgaagggcaagaaaaccaagaacggcaccgagatcatcaagaattacagattcagcaaggagaagtttatcctgcacgtgccaatcaccctgaacttctgctccaataacgagtatgtgaatgacatcgtgaacacaaagttctacaatttttccaacctgcactttctgggcatcgataggggcgagaagcacctggcctactattctctggtgaataagaacggcgagatcgtggaccagggcacactgaacctgcctttcaccgacaaggatggcaatcagcgcagcatcaagaaggagaagtacttttataacaagcaggaggacaagtgggaggccaaggaggtggattgttggaattataacgacctgctggatgccatggcctctaaccgggacatggccagaaagaattggcagaggatcggcaccatcaaggaggccaagaacggctacgtgagcctggtcatcaggaagatcgccgatctggccgtgaataacgagcgccccgccttcatcgtgctggaggacctgaatacaggctttaagcggtccagacagaagatcgataagagcgtgtaccagaagttcgagctggccctggccaagaagctgaactttctggtggacaagaatgccaagcgcgatgagatcggctcccctacaaaggccctgcagctgaccccccctgtgaataactacggcgacattgagaacaagaagcaggccggcatcatgctgtatacccgggccaattatacctctcagacagatccagccacaggctggagaaagaccatctatctgaaggccggccccgaggagacaacatacaagaaggacggcaagatcaagaacaagagcgtgaaggaccagatcatcgagacattcaccgatatcggctttgacggcaaggattactatttcgagtacgacaagggcgagtttgtggatgagaaaaccggcgagatcaagcccaagaagtggcggctgtactccggcgagaatggcaagtccctggacaggttccgcggagagagggagaaggataagtatgagtggaagatcgacaagatcgatatcgtgaagatcctggacgatctgttcgtgaattttgacaagaacatcagcctgctgaagcagctgaaggagggcgtggagctgacccggaataacgagcacggcacaggcgagtccctgagattcgccatcaacctgatccagcagatccggaataccggcaataacgagagagacaacgatttcatcctgtccccagtgagggacgagaatggcaagcactttgactctcgcgagtactgggataaggagacaaagggcgagaagatcagcatgcccagctccggcgatgccaatggcgccttcaacatcgcccggaagggcatcatcatgaacgcccacatcctggccaatagcgactccaaggatctgtccctgttcgtgtctgacgaggagtgggatctgcacctgaataacaagaccgagtggaagaagcagctgaacatcttttctagcaggaaggccatggccaagcgcaagaagaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 438 - protein, 1477 aa, Artificial Sequence; identical to SEQ ID NO: 68
  source: /note="Description of Artificial Sequence: Synthetic polypeptide"

SEQ ID NO: 439 - DNA, 4206 bp, Artificial Sequence
  source: /note="Description of Artificial Sequence: Synthetic polynucleotide"
ggtaccatggagaacatcttcgaccagtttatcggcaagtacagcctgtccaagaccctgagattcgagctgaagcccgtgggcaagacagaggacttcctgaagatcaacaaggtgtttgagaaggatcagaccatcgacgatagctacaatcaggccaagttctattttgattccctgcaccagaagtttatcgacgccgccctggcctccgataagacatccgagctgtctttccagaactttgccgacgtgctggagaagcagaataagatcatcctggataagaagagagagatgggcgccctgaggaagcgcgacaagaacgccgtgggcatcgataggctgcagaaggagatcaatgacgccgaggatatcatccagaaggagaaggagaagatctacaaggacgtgcgcaccctgttcgataacgaggccgagtcttggaaaacctactatcaggagcgggaggtggacggcaagaagatcaccttcagcaaggccgacctgaagcagaagggcgccgattttctgacagccgccggcatcctgaaggtgctgaagtatgagttccccgaggagaaggagaaggagtttcaggccaagaaccagccctccctgttcgtggaggagaaggagaatcctggccagaagaggtacatcttcgactcttttgataagttcgccggctatctgaccaagtttcagcagacaaagaagaatctgtacgcagcagacggcaccagcacagcagtggccacccgcatcgccgataactttatcatcttccaccagaataccaaggtgttccgggacaagtacaagaacaatcacacagacctgggcttcgatgaggagaacatctttgagatcgagaggtataagaattgcctgctgcagcgcgagatcgagcacatcaagaatgagaatagctacaacaagatcatcggccggatcaataagaagatcaaggagtatcgggaccagaaggccaaggataccaagctgacaaagtccgacttccctttctttaagaacctggataagcagatcctgggcgaggtggagaaggagaagcagctgatcgagaaaacccgggagaaaaccgaggaggacgtgctgatcgagcggttcaaggagttcatcgagaacaatgaggagaggttcaccgccgccaagaagctgatgaatgccttctgtaacggcgagtttgagtccgagtacgagggcatctatctgaagaataaggccatcaacacaatctcccggagatggttcgtgtctgacagagattttgagctgaagctgcctcagcagaagtccaagaacaagtctgagaagaatgagccaaaggtgaagaagttcatctccatcgccgagatcaagaacgccgtggaggagctggacggcgatatctttaaggccgtgttctacgacaagaagatcatcgcccagggcggctctaagctggagcagttcctggtcatctggaagtacgagtttgagtatctgttccgggacatcgagagagagaacggcgagaagctgctgggctatgatagctgcctgaagatcgccaagcagctgggcatcttcccacaggagaaggaggcccgcgagaaggcaaccgccgtgatcaagaattacgccgacgccggcctgggcatcttccagatgatgaagtatttttctctggacgataaggatcggaagaacacccccggccagctgagcacaaatttctacgccgagtatgacggctactacaaggatttcgagtttatcaagtactacaacgagtttaggaacttcatcaccaagaagcctttcgacgaggataagatcaagctgaactttgagaatggcgccctgctgaagggctgggacgagaacaaggagtacgatttcatgggcgtgatcctgaagaaggagggccgcctgtatctgggcatcatgcacaagaaccaccggaagctgtttcagtccatgggcaatgccaagggcgacaacgccaatagataccagaagatgatctataagcagatcgccgacgcctctaaggatgtgcccaggctgctgctgaccagcaagaaggccatggagaagttcaagccttcccaggagatcctgagaatcaagaaggagaaaaccttcaagcgggagagcaagaacttttccctgagagatctgcacgccctgatcgagtactataggaactgcatccctcagtacagcaattggtccttttatgacttccagtttcaggataccggcaagtaccagaatatcaaggagttcacagacgatgtgcagaagtacggctataagatctcctttcgcgacatcgacgatgagtatatcaatcaggccctgaacgagggcaagatgtacctgttcgaggtggtgaacaaggatatctataacaccaagaatggctccaagaatctgcacacactgtactttgagcacatcctgtctgccgagaacctgaatgacccagtgttcaagctgtctggcatggccgagatctttcagcggcagcccagcgtgaacgaaagagagaagatcaccacacagaagaatcagtgtatcctggacaagggcgatagagcctacaagtataggcgctacaccgagaagaagatcatgttccacatgagcctggtgctgaacacaggcaagggcgagatcaagcaggtgcagtttaataagatcatcaaccagaggatcagctcctctgacaacgagatgagggtgaatgtgatcggcatcgatcgcggcgagaagaacctgctgtactatagcgtggtgaagcagaatggcgagatcatcgagcaggcctccctgaacgagatcaatggcgtgaactaccgggacaagctgatcgagagggagaaggagcgcctgaagaaccggcagagctggaagcctgtggtgaagatcaaggatctgaagaagggctacatctcccacgtgatccacaagatctgccagctgatcgagaagtattctgccatcgtggtgctggaggacctgaatatgagattcaagcagatcaggggaggaatcgagcggagcgtgtaccagcagttcgagaaggccctgatcgataagctgggctatctggtgtttaaggacaacagggatctgagggcaccaggaggcgtgctgaatggctaccagctgtctgccccctttgtgagcttcgagaagatgcgcaagcagaccggcatcctgttctacacacaggccgagtataccagcaagacagacccaatcaccggctttcggaagaacgtgtatatctctaatagcgcctccctggataagatcaaggaggccgtgaagaagttcgacgccatcggctgggatggcaaggagcagtcttacttctttaagtacaacccttacaacctggccgacgagaagtataagaactctaccgtgagcaaggagtgggccatctttgccagcgccccaagaatccggagacagaagggcgaggacggctactggaagtatgatagggtgaaagtgaatgaggagttcgagaagctgctgaaggtctggaattttgtgaacccaaaggccacagatatcaagcaggagatcatcaagaaggagaaggcaggcgacctgcagggagagaaggagctggatggccggctgagaaacttttggcactctttcatctacctgtttaacctggtgctggagctgcgcaattctttcagcctgcagatcaagatcaaggcaggagaagtgatcgcagtggacgagggcgtggacttcatcgccagcccagtgaagcccttctttaccacacccaacccttacatcccctccaacctgtgctggctggccgtggagaatgcagacgcaaacggagcctataatatcgccaggaagggcgtgatgatcctgaagaagatccgcgagcacgccaagaaggaccccgagttcaagaagctgccaaacctgtttatcagcaatgcagagtgggacgaggcagcccgggattggggcaagtacgcaggcaccacagccctgaacctggaccacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 440 - protein, 1352 aa, Artificial Sequence; identical to SEQ ID NO: 71
  source: /note="Description of Artificial Sequence: Synthetic polypeptide"

SEQ ID NO: 441 - DNA, 3900 bp, Artificial Sequence
  source: /note="Description of Artificial Sequence: Synthetic polynucleotide"
ggtaccatgcagaccctgtttgagaacttcacaaatcagtacccagtgtccaagaccctgcgctttgagctgatcccccagggcaagacaaaggacttcatcgagcagaagggcctgctgaagaaggatgaggaccgggccgagaagtataagaaggtgaagaacatcatcgatgagtaccacaaggacttcatcgagaagtctctgaatggcctgaagctggacggcctggagaagtacaagaccctgtatctgaagcaggagaaggacgataaggataagaaggcctttgacaaggagaaggagaacctgcgcaagcagatcgccaatgccttccggaacaatgagaagtttaagacactgttcgccaaggagctgatcaagaacgatctgatgtctttcgcctgcgaggaggacaagaagaatgtgaaggagtttgaggccttcaccacatacttcaccggcttccaccagaaccgcgccaatatgtacgtggccgatgagaagagaacagccatcgccagcaggctgatccacgagaacctgccaaagtttatcgacaatatcaagatcttcgagaagatgaagaaggaggcccccgagctgctgtctcctttcaaccagaccctgaaggatatgaaggacgtgatcaagggcaccacactggaggagatctttagcctggattatttcaacaagaccctgacacagagcggcatcgacatctacaattccgtgatcggcggcagaacccctgaggagggcaagacaaagatcaagggcctgaacgagtacatcaataccgacttcaaccagaagcagacagacaagaagaagcggcagccaaagttcaagcagctgtataagcagatcctgagcgataggcagagcctgtcctttatcgccgaggccttcaagaacgacaccgagatcctggaggccatcgagaagttttacgtgaatgagctgctgcacttcagcaatgagggcaagtccacaaacgtgctggacgccatcaagaatgccgtgtctaacctggagagctttaacctgaccaagatgtatttccgctccggcgcctctctgacagacgtgagccggaaggtgtttggcgagtggagcatcatcaatagagccctggacaactactatgccaccacatatccaatcaagcccagagagaagtctgagaagtacgaggagaggaaggagaagtggctgaagcaggacttcaacgtgagcctgatccagaccgccatcgatgagtacgacaacgagacagtgaagggcaagaacagcggcaaagtgatcgccgattattttgccaagttctgcgacgataaggagacagacctgatccagaaggtgaacgagggctacatcgccgtgaaggatctgctgaatacaccctgtcctgagaacgagaagctgggcagcaataaggaccaggtgaagcagatcaaggcctttatggattctatcatggacatcatgcacttcgtgcgccccctgagcctgaaggataccgacaaggagaaggatgagacattctactccctgttcacacctctgtacgaccacctgacccagacaatcgccctgtataacaaggtgcggaactatctgacccagaagccttacagcacagagaagatcaagctgaacttcgagaacagcaccctgctgggcggctgggatctgaataaggagacagacaacacagccatcatcctgaggaaggataacctgtactatctgggcatcatggacaagaggcacaatcgcatctttcggaacgtgcccaaggccgataagaaggacttctgctacgagaagatggtgtataagctgctgcctggcgccaacaagatgctgccaaaggtgttcttttctcagagcagaatccaggagtttaccccttccgccaagctgctggagaactacgccaatgagacacacaagaagggcgataatttcaacctgaatcactgtcacaagctgatcgatttctttaaggactctatcaacaagcacgaggattggaagaatttcgactttaggttcagcgccacctccacctacgccgacctgagcggcttttaccacgaggtggagcaccagggctacaagatctcttttcagagcgtggccgattccttcatcgacgatctggtgaacgagggcaagctgtacctgttccagatctataataaggacttttccccattctctaagggcaagcccaacctgcacaccctgtactggaagatgctgtttgatgagaacaatctgaaggacgtggtgtataagctgaatggcgaggccgaggtgttctaccgcaagaagagcattgccgagaagaacaccacaatccacaaggccaatgagtccatcatcaacaagaatcctgataacccaaaggccaccagcaccttcaactatgatatcgtgaaggacaagagatacaccatcgacaagtttcagttccacatcccaatcacaatgaactttaaggccgagggcatcttcaacatgaatcagagggtgaatcagttcctgaaggccaatcccgatatcaacatcatcggcatcgacagaggcgagaggcacctgctgtactatgccctgatcaaccagaagggcaagatcctgaagcaggataccctgaatgtgatcgccaacgagaagcagaaggtggactaccacaatctgctggataagaaggagggcgaccgcgcaaccgcaaggcaggagtggggcgtgatcgagacaatcaaggagctgaaggagggctatctgtcccaggtcatccacaagctgaccgatctgatgatcgagaacaatgccatcatcgtgatggaggacctgaactttggcttcaagcggggcagacagaaggtggagaagcaggtgtatcagaagtttgagaagatgctgatcgataagctgaattacctggtggacaagaataagaaggcaaacgagctgggaggcctgctgaacgcattccagctggccaataagtttgagtccttccagaagatgggcaagcagaacggctttatcttctacgtgcccgcctggaatacctctaagacagatcctgccaccggctttatcgacttcctgaagccccgctatgagaacctgaatcaggccaaggatttctttgagaagtttgactctatccggctgaacagcaaggccgattactttgagttcgcctttgacttcaagaatttcaccgagaaggccgatggcggcagaaccaagtggacagtgtgcaccacaaacgaggacagatatgcctggaatagggccctgaacaataacaggggcagccaggagaagtacgacatcacagccgagctgaagtccctgttcgatggcaaggtggactataagtctggcaaggatctgaagcagcagatcgccagccaggagtccgccgacttctttaaggccctgatgaagaacctgtccatcaccctgtctctgagacacaataacggcgagaagggcgataatgagcaggactacatcctgtcccctgtggccgattctaagggccgcttctttgactcccggaaggccgacgatgacatgccaaagaatgccgacgccaacggcgcctatcacatcgccctgaagggcctgtggtgtctggagcagatcagcaagaccgatgacctgaagaaggtgaagctggccatctccaacaaggagtggctggagttcgtgcagacactgaagggcaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 442 - protein, 1250 aa, Artificial Sequence; identical to SEQ ID NO: 98
  source: /note="Description of Artificial Sequence: Synthetic polypeptide"

SEQ ID NO: 443 - DNA, 4071 bp, Artificial Sequence
  source: /note="Description of Artificial Sequence: Synthetic polynucleotide"
ggtaccatgacacagttcgagggctttaccaacctgtatcaggtgagcaagacactgcggtttgagctgatcccacagggcaagaccctgaagcacatccaggagcagggcttcatcgaggaggacaaggcccgcaatgatcactacaaggagctgaagcccatcatcgatcggatctacaagacctatgccgaccagtgcctgcagctggtgcagctggattgggagaacctgagcgccgccatcgactcctatagaaaggagaaaaccgaggagacaaggaacgccctgatcgaggagcaggccacatatcgcaatgccatccacgactacttcatcggccggacagacaacctgaccgatgccatcaataagagacacgccgagatctacaagggcctgttcaaggccgagctgtttaatggcaaggtgctgaagcagctgggcaccgtgaccacaaccgagcacgagaacgccctgctgcggagcttcgacaagtttacaacctacttctccggcttttatgagaacaggaagaacgtgttcagcgccgaggatatcagcacagccatcccacaccgcatcgtgcaggacaacttccccaagtttaaggagaattgtcacatcttcacacgcctgatcaccgccgtgcccagcctgcgggagcactttgagaacgtgaagaaggccatcggcatcttcgtgagcacctccatcgaggaggtgttttccttccctttttataaccagctgctgacacagacccagatcgacctgtataaccagctgctgggaggaatctctcgggaggcaggcaccgagaagatcaagggcctgaacgaggtgctgaatctggccatccagaagaatgatgagacagcccacatcatcgcctccctgccacacagattcatccccctgtttaagcagatcctgtccgataggaacaccctgtctttcatcctggaggagtttaagagcgacgaggaagtgatccagtccttctgcaagtacaagacactgctgagaaacgagaacgtgctggagacagccgaggccctgtttaacgagctgaacagcatcgacctgacacacatcttcatcagccacaagaagctggagacaatcagcagcgccctgtgcgaccactgggatacactgaggaatgccctgtatgagcggagaatctccgagctgacaggcaagatcaccaagtctgccaaggagaaggtgcagcgcagcctgaagcacgaggatatcaacctgcaggagatcatctctgccgcaggcaaggagctgagcgaggccttcaagcagaaaaccagcgagatcctgtcccacgcacacgccgccctggatcagccactgcctacaaccctgaagaagcaggaggagaaggagatcctgaagtctcagctggacagcctgctgggcctgtaccacctgctggactggtttgccgtggatgagtccaacgaggtggaccccgagttctctgcccggctgaccggcatcaagctggagatggagccttctctgagcttctacaacaaggccagaaattatgccaccaagaagccctactccgtggagaagttcaagctgaactttcagatgcctacactggcctctggctgggacgtgaataaggagaagaacaatggcgccatcctgtttgtgaagaacggcctgtactatctgggcatcatgccaaagcagaagggcaggtataaggccctgagcttcgagcccacagagaaaaccagcgagggctttgataagatgtactatgactacttccctgatgccgccaagatgatcccaaagtgcagcacccagctgaaggccgtgacagcccactttcagacccacacaacccccatcctgctgtccaacaatttcatcgagcctctggagatcacaaaggagatctacgacctgaacaatcctgagaaggagccaaagaagtttcagacagcctacgccaagaaaaccggcgaccagaagggctacagagaggccctgtgcaagtggatcgacttcacaagggattttctgtccaagtataccaagacaacctctatcgatctgtctagcctgcggccatcctctcagtataaggacctgggcgagtactatgccgagctgaatcccctgctgtaccacatcagcttccagagaatcgccgagaaggagatcatggatgccgtggagacaggcaagctgtacctgttccagatctataacaaggactttgccaagggccaccacggcaagcctaatctgcacacactgtattggaccggcctgttttctccagagaacctggccaagacaagcatcaagctgaatggccaggccgagctgttctaccgccctaagtccaggatgaagaggatggcacaccggctgggagagaagatgctgaacaagaagctgaaggatcagaaaaccccaatccccgacaccctgtaccaggagctgtacgactatgtgaatcacagactgtcccacgacctgtctgatgaggccagggccctgctgcccaacgtgatcaccaaggaggtgtctcacgagatcatcaaggataggcgctttaccagcgacaagttctttttccacgtgcctatcacactgaactatcaggccgccaattccccatctaagttcaaccagagggtgaatgcctacctgaaggagcaccccgagacacctatcatcggcatcgatcggggcgagagaaacctgatctatatcacagtgatcgactccaccggcaagatcctggagcagcggagcctgaacaccatccagcagtttgattaccagaagaagctggacaacagggagaaggagagggtggcagcaaggcaggcctggtctgtggtgggcacaatcaaggatctgaagcagggctatctgagccaggtcatccacgagatcgtggacctgatgatccactaccaggccgtggtggtgctggagaacctgaatttcggctttaagagcaagaggaccggcatcgccgagaaggccgtgtaccagcagttcgagaagatgctgatcgataagctgaattgcctggtgctgaaggactatccagcagagaaagtgggaggcgtgctgaacccataccagctgacagaccagttcacctcctttgccaagatgggcacccagtctggcttcctgttttacgtgcctgccccatatacatctaagatcgatcccctgaccggcttcgtggaccccttcgtgtggaaaaccatcaagaatcacgagagccgcaagcacttcctggagggcttcgactttctgcactacgacgtgaaaaccggcgacttcatcctgcactttaagatgaacagaaatctgtccttccagaggggcctgcccggctttatgcctgcatgggatatcgtgttcgagaagaacgagacacagtttgacgccaagggcacccctttcatcgccggcaagagaatcgtgccagtgatcgagaatcacagattcaccggcagataccgggacctgtatcctgccaacgagctgatcgccctgctggaggagaagggcatcgtgttcagggatggctccaacatcctgccaaagctgctggagaatgacgattctcacgccatcgacaccatggtggccctgatccgcagcgtgctgcagatgcggaactccaatgccgccacaggcgaggactatatcaacagccccgtgcgcgatctgaatggcgtgtgcttcgactcccggtttcagaacccagagtggcccatggacgccgatgccaatggcgcctaccacatcgccctgaagggccagctgctgctgaatcacctgaaggagagcaaggatctgaagctgcagaacggcatctccaatcaggactggctggcctacatccaggagctgcgcaacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 444 - protein, 1307 aa, Artificial Sequence; identical to SEQ ID NO: 77
  source: /note="Description of Artificial Sequence: Synthetic polypeptide"

SEQ ID NO: 445 - DNA, 3768 bp, Artificial Sequence
  source: /note="Description of Artificial Sequence: Synthetic polynucleotide"
ggtaccatgtactatgagtccctgaccaagcagtaccccgtgtctaagacaatccggaatgagctgatccctatcggcaagacactggataacatccgccagaacaatatcctggagagcgacgtgaagcggaagcagaactacgagcacgtgaagggcatcctggatgagtatcacaagcagctgatcaacgaggccctggacaattgcaccctgccatccctgaagatcgccgccgagatctacctgaagaatcagaaggaggtgtctgacagagaggatttcaacaagacacaggacctgctgaggaaggaggtggtggagaagctgaaggcccacgagaactttaccaagatcggcaagaaggacatcctggatctgctggagaagctgccttccatctctgaggacgattacaatgccctggagagcttccgcaacttttacacctatttcacatcctacaacaaggtgcgggagaatctgtattctgataaggagaagagctccacagtggcctacagactgatcaacgagaatttcccaaagtttctggacaatgtgaagagctataggtttgtgaaaaccgcaggcatcctggcagatggcctgggagaggaggagcaggactccctgttcatcgtggagacattcaacaagaccctgacacaggacggcatcgatacctacaattctcaagtgggcaagatcaactctagcatcaatctgtataaccagaagaatcagaaggccaatggcttcagaaagatccccaagatgaagatgctgtataagcagatcctgtccgatagggaggagtctttcatcgacgagtttcagagcgatgaggtgctgatcgacaacgtggagtcttatggcagcgtgctgatcgagtctctgaagtcctctaaggtgagcgccttctttgatgccctgagagagtctaagggcaagaacgtgtacgtgaagaatgacctggccaagacagccatgagcaacatcgtgttcgagaattggaggacctttgacgatctgctgaaccaggagtacgacctggccaacgagaacaagaagaaggacgataagtatttcgagaagcgccagaaggagctgaagaagaataagagctactccctggagcacctgtgcaacctgtccgaggattcttgtaacctgatcgagaattatatccaccagatctccgacgatatcgagaatatcatcatcaacaatgagacattcctgcgcatcgtgatcaatgagcacgacaggtcccgcaagctggccaagaaccggaaggccgtgaaggccatcaaggactttctggattctatcaaggtgctggagcgggagctgaagctgatcaacagctccggccaggagctggagaaggatctgatcgtgtactctgcccacgaggagctgctggtggagctgaagcaggtggacagcctgtataacatgaccagaaattatctgacaaagaagcctttctctaccgagaaggtgaagctgaactttaatcgcagcacactgctgaacggctgggatcggaataaggagacagacaacctgggcgtgctgctgctgaaggacggcaagtactatctgggcatcatgaacacaagcgccaataaggccttcgtgaatccccctgtggccaagaccgagaaggtgtttaagaaggtggattacaagctgctgccagtgcccaaccagatgctgccaaaggtgttctttgccaagagcaatatcgacttctataacccctctagcgagatctactccaattataagaagggcacccacaagaagggcaatatgttttccctggaggattgtcacaacctgatcgacttctttaaggagtctatcagcaagcacgaggactggagcaagttcggctttaagttcagcgatacagcctcctacaacgacatctccgagttctatcgcgaggtggagaagcagggctacaagctgacctatacagacatcgatgagacatacatcaatgatctgatcgagcggaacgagctgtacctgttccagatctataataaggactttagcatgtactccaagggcaagctgaacctgcacacactgtatttcatgatgctgtttgatcagcgcaatatcgacgacgtggtgtataagctgaacggagaggcagaggtgttctataggccagcctccatctctgaggacgagctgatcatccacaaggccggcgaggagatcaagaacaagaatcctaaccgggccagaaccaaggagacaagcaccttcagctacgacatcgtgaaggataagcggtatagcaaggataagtttaccctgcacatccccatcacaatgaacttcggcgtggatgaggtgaagcggttcaacgacgccgtgaacagcgccatccggatcgatgagaatgtgaacgtgatcggcatcgaccggggcgagagaaatctgctgtacgtggtggtcatcgactctaagggcaacatcctggagcagatctccctgaactctatcatcaataaggagtacgacatcgagacagattatcacgcactgctggatgagagggagggcggcagagataaggcccggaaggactggaacaccgtggagaatatcagggacctgaaggccggctacctgagccaggtggtgaacgtggtggccaagctggtgctgaagtataatgccatcatctgcctggaggacctgaactttggcttcaagaggggccgccagaaggtggagaagcaggtgtaccagaagttcgagaagatgctgatcgataagctgaattacctggtcatcgacaagagccgcgagcagacatcccctaaggagctgggaggcgccctgaacgcactgcagctgacctctaagttcaagagctttaaggagctgggcaagcagtccggcgtgatctactatgtgcctgcctacctgacctctaagatcgatccaaccacaggcttcgccaatctgttttatatgaagtgtgagaacgtggagaagtccaagagattctttgacggctttgatttcatcaggttcaacgccctggagaacgtgttcgagttcggctttgactaccggagcttcacccagagggcctgcggcatcaattccaagtggaccgtgtgcaccaacggcgagcgcatcatcaagtatcggaatccagataagaacaatatgttcgacgagaaggtggtggtggtgaccgatgagatgaagaacctgtttgagcagtacaagatcccctatgaggatggcagaaatgtgaaggacatgatcatcagcaacgaggaggccgagttctaccggagactgtataggctgctgcagcagaccctgcagatgagaaacagcacctccgacggcacaagggattacatcatctcccctgtgaagaataagagagaggcctacttcaacagcgagctgtccgacggctctgtgccaaaggacgccgatgccaacggcgcctacaatatcgccagaaagggcctgtgggtgctggagcagatcaggcagaagagcgagggcgagaagatcaatctggccatgaccaacgccgagtggctggagtatgcccagacacacctgctgaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 446 - protein, 1206 aa, Artificial Sequence; identical to SEQ ID NO: 113
  source: /note="Description of Artificial Sequence: Synthetic polypeptide"

SEQ ID NO: 447 - DNA, 3864 bp, Artificial Sequence
  source: /note="Description of Artificial Sequence: Synthetic polynucleotide"
ggtaccatgaacaattacgacgagttcaccaagctgtatcctatccagaaaaccatccggtttgagctgaagccacagggcagaaccatggagcacctggagacattcaacttctttgaggaggaccgggatagagccgagaagtataagatcctgaaggaggccatcgacgagtaccacaagaagtttatcgatgagcacctgaccaatatgtccctggattggaactctctgaagcagatcagcgagaagtactataagagcagggaggagaaggacaagaaggtgttcctgtccgagcagaagaggatgcgccaggagatcgtgtctgagtttaagaaggacgatcgcttcaaggacctgttttccaagaagctgttctctgagctgctgaaggaggagatctacaagaagggcaaccaccaggagatcgacgccctgaagagcttcgataagttttccggctatttcatcggcctgcacgagaataggaagaacatgtactccgacggcgatgagatcaccgccatctccaatcgcatcgtgaatgagaacttccccaagtttctggataacctgcagaagtaccaggaggccaggaagaagtatcctgagtggatcatcaaggccgagagcgccctggtggcccacaatatcaagatggacgaggtgttctccctggagtactttaataaggtgctgaaccaggagggcatccagcggtacaacctggccctgggcggctatgtgaccaagagcggcgagaagatgatgggcctgaatgatgccctgaacctggcccaccagtccgagaagagctccaagggcagaatccacatgacccccctgttcaagcagatcctgtccgagaaggagtccttctcttacatccccgacgtgtttacagaggattctcagctgctgcctagcatcggcggcttctttgcccagatcgagaatgacaaggatggcaacatcttcgaccgggccctggagctgatctctagctacgccgagtatgataccgagcggatctatatcagacaggccgacatcaatagagtgtccaacgtgatctttggagagtggggcaccctgggaggcctgatgagggagtacaaggccgactctatcaatgatatcaacctggagcgcacatgcaagaaggtggacaagtggctggattctaaggagtttgccctgagcgatgtgctggaggccatcaagaggaccggcaacaatgacgccttcaacgagtatatctccaagatgcggacagccagagagaagatcgatgccgcccgcaaggagatgaagttcatcagcgagaagatctccggcgatgaggagtctatccacatcatcaagaccctgctggacagcgtgcagcagttcctgcacttctttaatctgtttaaggcaaggcaggacatcccactggatggagccttctacgccgagtttgacgaggtgcacagcaagctgtttgccatcgtgcccctgtataacaaggtgcggaactatctgaccaagaacaatctgaacacaaagaagatcaagctgaatttcaagaaccctacactggccaatggctgggaccagaacaaggtgtacgattatgcctccctgatctttctgcgggacggcaattactatctgggcatcatcaatcctaagagaaagaagaacatcaagttcgagcagggctctggcaacggccccttctaccggaagatggtgtataagcagatccccggccctaataagaacctgccaagagtgttcctgacctccacaaagggcaagaaggagtataagccctctaaggagatcatcgagggctacgaggccgacaagcacatcaggggcgataagttcgacctggatttttgtcacaagctgatcgatttctttaaggagtccatcgagaagcacaaggactggtctaagttcaacttctacttcagcccaaccgagagctatggcgacatctctgagttctacctggatgtggagaagcagggctatcgcatgcactttgagaatatcagcgccgagacaatcgacgagtatgtggagaagggcgatctgtttctgttccagatctacaacaaggattttgtgaaggccgccaccggcaagaaggacatgcacacaatctactggaatgccgccttcagccccgagaacctgcaggacgtggtggtgaagctgaacggcgaggccgagctgttttatagggacaagtccgatatcaaggagatcgtgcaccgcgagggcgagatcctggtgaataggacctacaacggccgcacaccagtgcccgacaagatccacaagaagctgaccgattatcacaatggccggacaaaggacctgggcgaggccaaggagtacctggataaggtgagatacttcaaggcccactatgacatcaccaaggatcggagatacctgaacgacaagatctatttccacgtgcctctgaccctgaacttcaaggccaacggcaagaagaatctgaacaagatggtcatcgagaagttcctgtccgatgagaaggcccacatcatcggcatcgacaggggcgagcgcaatctgctgtactattccatcatcgacaggtctggcaagatcatcgatcagcagagcctgaatgtgatcgacggctttgattatcgggagaagctgaaccagagagagatcgagatgaaggatgcccgccagtcttggaacgccatcggcaagatcaaggacctgaaggagggctacctgagcaaggccgtgcacgagatcaccaagatggccatccagtataatgccatcgtggtcatggaggagctgaactacggcttcaagcggggccggttcaaggtggagaagcagatctatcagaagttcgagaatatgctgatcgataagatgaactacctggtgtttaaggacgcacctgatgagtccccaggaggcgtgctgaatgcctaccagctgacaaacccactggagtctttcgccaagctgggcaagcagaccggcatcctgttttacgtgccagccgcctatacatccaagatcgaccccaccacaggcttcgtgaatctgtttaacacctcctctaagacaaacgcccaggagcggaaggagttcctgcagaagtttgagagcatctcctattctgccaaggatggcggcatctttgccttcgcctttgactacagaaagttcggcaccagcaagacagatcacaagaacgtgtggaccgcctatacaaacggcgagaggatgcgctacatcaaggagaagaagcggaatgagctgtttgacccttctaaggagatcaaggaggccctgaccagctccggcatcaagtacgatggcggccagaacatcctgccagacatcctgaggagcaacaataacggcctgatctacacaatgtattctagcttcatcgccgccatccagatgcgcgtgtacgacggcaaggaggattatatcatcagccccatcaagaactccaagggcgagttctttaggaccgaccccaagaggcgcgagctgcctatcgacgccgatgccaatggcgcctacaacatcgccctgaggggagagctgacaatgagggcaatcgcagagaagttcgaccctgatagcgagaagatggccaagctggagctgaagcacaaggattggttcgagtttatgcagaccagaggcgacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 448 - protein, 1238 aa, Artificial Sequence; identical to SEQ ID NO: 104
  source: /note="Description of Artificial Sequence: Synthetic polypeptide"

SEQ ID NO: 449 - DNA, 3996 bp, Artificial Sequence
  source: /note="Description of Artificial Sequence: Synthetic polynucleotide"
ggtaccatgaacggcaataggtccatcgtgtaccgcgagttcgtgggcgtgatccccgtggccaagaccctgaggaatgagctgcgccctgtgggccacacacaggagcacatcatccagaacggcctgatccaggaggacgagctgcggcaggagaagagcaccgagctgaagaacatcatggacgattactatagagagtacatcgataagtctctgagcggcgtgaccgacctggacttcaccctgctgttcgagctgatgaacctggtgcagagctccccctccaaggacaataagaaggccctggagaaggagcagtctaagatgagggagcagatctgcacccacctgcagtccgactctaactacaagaatatctttaacgccaagctgctgaaggagatcctgcctgatttcatcaagaactacaatcagtatgacgtgaaggataaggccggcaagctggagacactggccctgtttaatggcttcagcacatactttaccgacttctttgagaagaggaagaacgtgttcaccaaggaggccgtgagcacatccatcgcctaccgcatcgtgcacgagaactccctgatcttcctggccaatatgacctcttataagaagatcagcgagaaggccctggatgagatcgaagtgatcgagaagaacaatcaggacaagatgggcgattgggagctgaatcagatctttaaccctgacttctacaatatggtgctgatccagtccggcatcgacttctacaacgagatctgcggcgtggtgaatgcccacatgaacctgtactgtcagcagaccaagaacaattataacctgttcaagatgcggaagctgcacaagcagatcctggcctacaccagcaccagcttcgaggtgcccaagatgttcgaggacgatatgagcgtgtataacgccgtgaacgccttcatcgacgagacagagaagggcaacatcatcggcaagctgaaggatatcgtgaataagtacgacgagctggatgagaagagaatctatatcagcaaggacttttacgagacactgagctgcttcatgtccggcaactggaatctgatcacaggctgcgtggagaacttctacgatgagaacatccacgccaagggcaagtccaaggaggagaaggtgaagaaggccgtgaaggaggacaagtacaagtctatcaatgacgtgaacgatctggtggagaagtatatcgatgagaaggagaggaatgagttcaagaacagcaatgccaagcagtacatccgcgagatctccaacatcatcaccgacacagagacagcccacctggagtatgacgatcacatctctctgatcgagagcgaggagaaggccgacgagatgaagaagcggctggatatgtatatgaacatgtaccactgggccaaggcctttatcgtggacgaggtgctggacagagatgagatgttctacagcgatatcgacgatatctataatatcctggagaacatcgtgccactgtataatcgggtgagaaactacgtgacccagaagccctacaactctaagaagatcaagctgaatttccagagccctacactggccaatggctggtcccagtctaaggagttcgacaacaatgccatcatcctgatcagagataacaagtactatctggccatcttcaatgccaagaacaagccagacaagaagatcatccagggcaactccgataagaagaacgacaacgattacaagaagatggtgtataacctgctgccaggcgccaacaagatgctgcccaaggtgtttctgtctaagaagggcatcgagacattcaagccctccgactatatcatctctggctacaacgcccacaagcacatcaagacaagcgagaattttgatatctccttctgtcgggacctgatcgattacttcaagaacagcatcgagaagcacgccgagtggagaaagtatgagttcaagttttccgccaccgacagctactccgatatctctgagttctatcgggaggtggagatgcagggctacagaatcgactggacatatatcagcgaggccgacatcaacaagctggatgaggagggcaagatctatctgtttcagatctacaataaggatttcgccgagaacagcaccggcaaggagaatctgcacacaatgtactttaagaacatcttctccgaggagaatctgaaggacatcatcatcaagctgaacggccaggccgagctgttttatcggagagcctctgtgaagaatcccgtgaagcacaagaaggatagcgtgctggtgaacaagacctacaagaatcagctggacaacggcgacgtggtgagaatccccatccctgacgatatctataacgagatctacaagatgtataatggctacatcaaggagtccgacctgtctgaggccgccaaggagtacctggataaggtggaggtgaggaccgcccagaaggacatcgtgaaggattaccgctatacagtggacaagtacttcatccacacacctatcaccatcaactataaggtgaccgcccgcaacaatgtgaatgatatggtggtgaagtacatcgcccagaacgacgatatccacgtgatcggcatcgaccggggcgagagaaacctgatctacatctccgtgatcgattctcacggcaacatcgtgaagcagaaatcctacaacatcctgaacaactacgactacaagaagaagctggtggagaaggagaaaacccgggagtacgccagaaagaactggaagagcatcggcaatatcaaggagctgaaggagggctatatctccggcgtggtgcacgagatcgccatgctgatcgtggagtacaacgccatcatcgccatggaggacctgaattatggctttaagaggggccgcttcaaggtggagcggcaggtgtaccagaagtttgagagcatgctgatcaataagctgaactatttcgccagcaaggagaagtccgtggacgagccaggaggcctgctgaagggctatcagctgacctacgtgcccgataatatcaagaacctgggcaagcagtgcggcgtgatcttttacgtgcctgccgccttcaccagcaagatcgacccatccacaggctttatctctgccttcaactttaagtctatcagcacaaatgcctctcggaagcagttctttatgcagtttgacgagatcagatactgtgccgagaaggatatgttcagctttggcttcgactacaacaacttcgatacctacaacatcacaatgggcaagacacagtggaccgtgtatacaaacggcgagagactgcagtctgagttcaacaatgccaggcgcaccggcaagacaaagagcatcaatctgacagagacaatcaagctgctgctggaggacaatgagatcaactacgccgacggccacgatatcaggatcgatatggagaagatggacgaggataagaagagcgagttctttgcccagctgctgagcctgtataagctgaccgtgcagatgcgcaattcctatacagaggccgaggagcaggagaacggcatctcttacgacaagatcatcagccctgtgatcaatgatgagggcgagttctttgactccgataactataaggagtctgacgataaggagtgcaagatgccaaaggacgccgatgccaacggcgcctactgtatcgccctgaagggcctgtatgaggtgctgaagatcaagagcgagtggaccgaggacggctttgataggaattgcctgaagctgccacacgcagagtggctggacttcatccagaacaagcggtacgagaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 450 - protein, 1282 aa, Artificial Sequence; identical to SEQ ID NO: 85
  source: /note="Description of Artificial Sequence: Synthetic polypeptide"

SEQ ID NO: 451 - DNA, 4269 bp, Artificial Sequence
  source: /note="Description of Artificial Sequence: Synthetic polynucleotide"
ggtaccatgctgttccaggactttacccacctgtatccactgtccaagacagtgagatttgagctgaagcccatcgataggaccctggagcacatccacgccaagaacttcctgtctcaggacgagacaatggccgatatgcaccagaaggtgaaagtgatcctggacgattaccaccgcgacttcatcgccgatatgatgggcgaggtgaagctgaccaagctggccgagttctatgacgtgtacctgaagtttcggaagaacccaaaggacgatgagctgcagaagcagctgaaggatctgcaggccgtgctgagaaaggagatcgtgaagcccatcggcaatggcggcaagtataaggccggctacgacaggctgttcggcgccaagctgtttaaggacggcaaggagctgggcgatctggccaagttcgtgatcgcacaggagggagagagctccccaaagctggcccacctggcccacttcgagaagttttccacctatttcacaggctttcacgataaccggaagaatatgtattctgacgaggataagcacaccgccatcgcctaccgcctgatccacgagaacctgccccggtttatcgacaatctgcagatcctgaccacaatcaagcagaagcactctgccctgtacgatcagatcatcaacgagctgaccgccagcggcctggacgtgtctctggccagccacctggatggctatcacaagctgctgacacaggagggcatcaccgcctacaatacactgctgggaggaatctccggagaggcaggctctcctaagatccagggcatcaacgagctgatcaattctcaccacaaccagcactgccacaagagcgagagaatcgccaagctgaggccactgcacaagcagatcctgtccgacggcatgagcgtgtccttcctgccctctaagtttgccgacgatagcgagatgtgccaggccgtgaacgagttctatcgccactacgccgacgtgttcgccaaggtgcagagcctgttcgacggctttgacgatcaccagaaggatggcatctacgtggagcacaagaacctgaatgagctgtccaagcaggccttcggcgactttgcactgctgggacgcgtgctggacggatactatgtggatgtggtgaatccagagttcaacgagcggtttgccaaggccaagaccgacaatgccaaggccaagctgacaaaggagaaggataagttcatcaagggcgtgcactccctggcctctctggagcaggccatcgagcactataccgcaaggcacgacgatgagagcgtgcaggcaggcaagctgggacagtacttcaagcacggcctggccggagtggacaaccccatccagaagatccacaacaatcacagcaccatcaagggctttctggagagggagcgccctgcaggagagagagccctgccaaagatcaagtccggcaagaatcctgagatgacacagctgaggcagctgaaggagctgctggataacgccctgaatgtggcccacttcgccaagctgctgaccacaaagaccacactggacaatcaggatggcaacttctatggcgagtttggcgtgctgtacgacgagctggccaagatccccaccctgtataacaaggtgagagattacctgagccagaagcctttctccaccgagaagtacaagctgaactttggcaatccaacactgctgaatggctgggacctgaacaaggagaaggataatttcggcgtgatcctgcagaaggacggctgctactatctggccctgctggacaaggcccacaagaaggtgtttgataacgcccctaatacaggcaagagcatctatcagaagatgatctataagtacctggaggtgaggaagcagttccccaaggtgttcttttccaaggaggccatcgccatcaactaccacccttctaaggagctggtggagatcaaggacaagggccggcagagatccgacgatgagcgcctgaagctgtatcggtttatcctggagtgtctgaagatccaccctaagtacgataagaagttcgagggcgccatcggcgacatccagctgtttaagaaggataagaagggcagagaggtgccaatcagcgagaaggacctgttcgataagatcaacggcatcttttctagcaagcctaagctggagatggaggacttctttatcggcgagttcaagaggtataacccaagccaggacctggtggatcagtataatatctacaagaagatcgactccaacgataatcgcaagaaggagaatttctacaacaatcaccccaagtttaagaaggatctggtgcggtactattacgagtctatgtgcaagcacgaggagtgggaggagagcttcgagttttccaagaagctgcaggacatcggctgttacgtggatgtgaacgagctgtttaccgagatcgagacacggagactgaattataagatctccttctgcaacatcaatgccgactacatcgatgagctggtggagcagggccagctgtatctgttccagatctacaacaaggacttttccccaaaggcccacggcaagcccaatctgcacaccctgtacttcaaggccctgttttctgaggacaacctggccgatcctatctataagctgaatggcgaggcccagatcttctacagaaaggcctccctggacatgaacgagacaacaatccacagggccggcgaggtgctggagaacaagaatcccgataatcctaagaagagacagttcgtgtacgacatcatcaaggataagaggtacacacaggacaagttcatgctgcacgtgccaatcaccatgaactttggcgtgcagggcatgacaatcaaggagttcaataagaaggtgaaccagtctatccagcagtatgacgaggtgaacgtgatcggcatcgatcggggcgagagacacctgctgtacctgaccgtgatcaatagcaagggcgagatcctggagcagtgttccctgaacgacatcaccacagcctctgccaatggcacacagatgaccacaccttaccacaagatcctggataagagggagatcgagcgcctgaacgcccgggtgggatggggcgagatcgagacaatcaaggagctgaagtctggctatctgagccacgtggtgcaccagatcagccagctgatgctgaagtacaacgccatcgtggtgctggaggacctgaatttcggctttaagaggggccgctttaaggtggagaagcagatctatcagaacttcgagaatgccctgatcaagaagctgaaccacctggtgctgaaggacaaggccgacgatgagatcggctcttacaagaatgccctgcagctgaccaacaatttcacagatctgaagagcatcggcaagcagaccggcttcctgttttatgtgcccgcctggaacacctctaagatcgaccctgagacaggctttgtggatctgctgaagccaagatacgagaacatcgcccagagccaggccttctttggcaagttcgacaagatctgctataatgccgacaaggattacttcgagtttcacatcgactacgccaagtttaccgataaggccaagaatagccgccagatctggacaatctgttcccacggcgacaagcggtacgtgtacgataagacagccaaccagaataagggcgccgccaagggcatcaacgtgaatgatgagctgaagtccctgttcgcccgccaccacatcaacgagaagcagcccaacctggtcatggacatctgccagaacaatgataaggagtttcacaagtctctgatgtacctgctgaaaaccctgctggccctgcggtacagcaacgcctcctctgacgaggatttcatcctgtcccccgtggcaaacgacgagggcgtgttctttaatagcgccctggccgacgatacacagcctcagaatgccgatgccaacggcgcctaccacatcgccctgaagggcctgtggctgctgaatgagctgaagaactccgacgatctgaacaaggtgaagctggccatcgacaatcagacctggctgaatttcgcccagaacaggaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 452 - protein, 1373 aa, Artificial Sequence; identical to SEQ ID NO: 70
  source: /note="Description of Artificial Sequence: Synthetic polypeptide"

SEQ ID NO: 453 - DNA, 3939 bp, Artificial Sequence
  source: /note="Description of Artificial Sequence: Synthetic polynucleotide"
ggtaccatggaggactattccggctttgtgaacatctactctatccagaaaaccctgaggttcgagctgaagccagtgggcaagacactggagcacatcgagaagaagggcttcctgaagaaggacaagatccgggccgaggattacaaggccgtgaagaagatcatcgataagtaccacagagcctatatcgaggaggtgtttgattccgtgctgcaccagaagaagaagaaggacaagacccgcttttctacacagttcatcaaggagatcaaggagttcagcgagctgtactataagaccgagaagaacatccccgacaaggagaggctggaggccctgagcgagaagctgcgcaagatgctggtgggcgcctttaagggcgagttctccgaggaggtggccgagaagtataagaacctgttttctaaggagctgatcaggaatgagatcgagaagttctgcgagacagacgaggagcgcaagcaggtgtctaacttcaagagcttcaccacatactttaccggcttccactccaacaggcagaatatctattccgacgagaagaagtctacagccatcggctaccgcatcatccaccagaacctgcctaagttcctggataatctgaagatcatcgagtccatccagcggcggttcaaggacttcccatggtctgatctgaagaagaacctgaagaagatcgataagaatatcaagctgaccgagtacttcagcatcgacggcttcgtgaacgtgctgaatcagaagggcatcgatgcctacaacacaatcctgggcggcaagtccgaggagtctggcgagaagatccagggcctgaacgagtacatcaatctgtatcggcagaagaacaatatcgacagaaagaacctgcccaatgtgaagatcctgtttaagcagatcctgggcgatagggagacaaagagctttatccctgaggccttcccagacgatcagtccgtgctgaactctatcacagagttcgccaagtacctgaagctggataagaagaagaagagcatcatcgccgagctgaagaagtttctgagctccttcaatcgctacgagctggacggcatctatctggccaacgataatagcctggcctctatcagcaccttcctgtttgacgattggtcctttatcaagaagtccgtgtctttcaagtatgacgagtccgtgggcgaccccaagaagaagatcaagtctcccctgaagtacgagaaggagaaggagaagtggctgaagcagaagtactatacaatctctttcctgaacgatgccatcgagagctattccaagtctcaggacgagaagagggtgaagatccgcctggaggcctactttgccgagttcaagagcaaggacgatgccaagaagcagttcgacctgctggagaggatcgaggaggcctatgccatcgtggagcctctgctgggagcagagtacccaagggaccgcaacctgaaggccgataagaaggaagtgggcaagatcaaggacttcctggatagcatcaagtccctgcagttctttctgaagcctctgctgtccgccgagatctttgacgagaaggatctgggcttctacaatcagctggagggctactatgaggagatcgattctatcggccacctgtataacaaggtgcggaattatctgaccggcaagatctacagcaaggagaagtttaagctgaacttcgagaacagcaccctgctgaagggctgggacgagaaccgggaggtggccaatctgtgcgtgatcttcagagaggaccagaagtactatctgggcgtgatggataaggagaacaataccatcctgtccgacatccccaaggtgaagcctaacgagctgttttacgagaagatggtgtataagctgatccccacacctcacatgcagctgccccggatcatcttctctagcgacaacctgtctatctataatcctagcaagtccatcctgaagatcagagaggccaagagctttaaggagggcaagaacttcaagctgaaggactgtcacaagtttatcgatttctacaaggagtctatcagcaagaatgaggactggagcagattcgacttcaagttcagcaagaccagcagctacgagaacatcagcgagttttaccgggaggtggagagacagggctataacctggacttcaagaaggtgtctaagttctacatcgacagcctggtggaggatggcaagctgtacctgttccagatctataacaaggacttttctatcttcagcaagggcaagcccaatctgcacaccatctattttcggtccctgttctctaaggagaacctgaaggacgtgtgcctgaagctgaatggcgaggccgagatgttctttcggaagaagtccatcaactacgatgagaagaagaagcgggagggccaccaccccgagctgtttgagaagctgaagtatcctatcctgaaggacaagagatacagcgaggataagtttcagttccacctgcccatcagcctgaacttcaagtccaaggagcggctgaactttaatctgaaagtgaatgagttcctgaagagaaacaaggacatcaatatcatcggcatcgatcggggcgagagaaacctgctgtacctggtcatgatcaatcagaagggcgagatcctgaagcagaccctgctggacagcatgcagtccggcaagggccggcctgagatcaactacaaggagaagctgcaggagaaggagatcgagagggataaggcccgcaagagctggggcacagtggagaatatcaaggagctgaaggagggctatctgtctatcgtgatccaccagatcagcaagctgatggtggagaacaatgccatcgtggtgctggaggacctgaacatcggctttaagcggggcagacagaaggtggagcggcaggtgtaccagaagttcgagaagatgctgatcgataagctgaactttctggtgttcaaggagaataagccaaccgagccaggaggcgtgctgaaggcctatcagctgacagacgagtttcagtctttcgagaagctgagcaagcagaccggctttctgttctacgtgccaagctggaacacctccaagatcgaccccagaacaggctttatcgatttcctgcaccctgcctacgagaatatcgagaaggccaagcagtggatcaacaagtttgattccatcaggttcaattctaagatggactggtttgagttcaccgccgatacacgcaagttttccgagaacctgatgctgggcaagaatcgggtgtgggtcatctgcaccacaaatgtggagcggtacttcaccagcaagaccgccaacagctccatccagtacaatagcatccagatcaccgagaagctgaaggagctgtttgtggacatccctttcagcaacggccaggatctgaagccagagatcctgaggaagaatgacgccgtgttctttaagagcctgctgttttacatcaagaccacactgtccctgcgccagaacaatggcaagaagggcgaggaggagaaggacttcatcctgagcccagtggtggattccaagggccggttctttaactctctggaggccagcgacgatgagcccaaggacgccgatgccaatggcgcctaccacatcgccctgaagggcctgatgaacctgctggtgctgaatgagacaaaggaggagaacctgagcagaccaaagtggaagatcaagaataaggactggctggagttcgtgtgggagaggaaccgcaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 454 - protein, 1263 aa, Artificial Sequence; identical to SEQ ID NO: 89
  source: /note="Description of Artificial Sequence: Synthetic polypeptide"

SEQ ID NO: 455 - DNA, 3834 bp, Artificial Sequence
  source: /note="Description of Artificial Sequence: Synthetic polynucleotide"
ggtaccatgagcaagctggagaagtttacaaactgctactccctgtctaagaccctgaggttcaaggccatccctgtgggcaagacccaggagaacatcgacaataagcggctgctggtggaggacgagaagagagccgaggattataagggcgtgaagaagctgctggatcgctactatctgtcttttatcaacgacgtgctgcacagcatcaagctgaagaatctgaacaattacatcagcctgttccggaagaaaaccagaaccgagaaggagaataaggagctggagaacctggagatcaatctgcggaaggagatcgccaaggccttcaagggcaacgagggctacaagtccctgtttaagaaggatatcatcgagacaatcctgccagagttcctggacgataaggacgagatcgccctggtgaacagcttcaatggctttaccacagccttcaccggcttctttgataacagagagaatatgttttccgaggaggccaagagcacatccatcgccttcaggtgtatcaacgagaatctgacccgctacatctctaatatggacatcttcgagaaggtggacgccatctttgataagcacgaggtgcaggagatcaaggagaagatcctgaacagcgactatgatgtggaggatttctttgagggcgagttctttaactttgtgctgacacaggagggcatcgacgtgtataacgccatcatcggcggcttcgtgaccgagagcggcgagaagatcaagggcctgaacgagtacatcaacctgtataatcagaaaaccaagcagaagctgcctaagtttaagccactgtataagcaggtgctgagcgatcgggagtctctgagcttctacggcgagggctatacatccgatgaggaggtgctggaggtgtttagaaacaccctgaacaagaacagcgagatcttcagctccatcaagaagctggagaagctgttcaagaattttgacgagtactctagcgccggcatctttgtgaagaacggccccgccatcagcacaatctccaaggatatcttcggcgagtggaacgtgatccgggacaagtggaatgccgagtatgacgatatccacctgaagaagaaggccgtggtgaccgagaagtacgaggacgatcggagaaagtccttcaagaagatcggctccttttctctggagcagctgcaggagtacgccgacgccgatctgtctgtggtggagaagctgaaggagatcatcatccagaaggtggatgagatctacaaggtgtatggctcctctgagaagctgttcgacgccgattttgtgctggagaagagcctgaagaagaacgacgccgtggtggccatcatgaaggacctgctggattctgtgaagagcttcgagaattacatcaaggccttctttggcgagggcaaggagacaaacagggacgagtccttctatggcgattttgtgctggcctacgacatcctgctgaaggtggaccacatctacgatgccatccgcaattatgtgacccagaagccctactctaaggataagttcaagctgtattttcagaaccctcagttcatgggcggctgggacaaggataaggagacagactatcgggccaccatcctgagatacggctccaagtactatctggccatcatggataagaagtacgccaagtgcctgcagaagatcgacaaggacgatgtgaacggcaattacgagaagatcaactataagctgctgcccggccctaataagatgctgccaaaggtgttcttttctaagaagtggatggcctactataaccccagcgaggacatccagaagatctacaagaatggcacattcaagaagggcgatatgtttaacctgaatgactgtcacaagctgatcgacttctttaaggatagcatctcccggtatccaaagtggtccaatgcctacgatttcaacttttctgagacagagaagtataaggacatcgccggcttttacagagaggtggaggagcagggctataaggtgagcttcgagtctgccagcaagaaggaggtggataagctggtggaggagggcaagctgtatatgttccagatctataacaaggacttttccgataagtctcacggcacacccaatctgcacaccatgtacttcaagctgctgtttgacgagaacaatcacggacagatcaggctgagcggaggagcagagctgttcatgaggcgcgcctccctgaagaaggaggagctggtggtgcacccagccaactcccctatcgccaacaagaatccagataatcccaagaaaaccacaaccctgtcctacgacgtgtataaggataagaggttttctgaggaccagtacgagctgcacatcccaatcgccatcaataagtgccccaagaacatcttcaagatcaatacagaggtgcgcgtgctgctgaagcacgacgataacccctatgtgatcggcatcgataggggcgagcgcaatctgctgtatatcgtggtggtggacggcaagggcaacatcgtggagcagtattccctgaacgagatcatcaacaacttcaacggcatcaggatcaagacagattaccactctctgctggacaagaaggagaaggagaggttcgaggcccgccagaactggacctccatcgagaatatcaaggagctgaaggccggctatatctctcaggtggtgcacaagatctgcgagctggtggagaagtacgatgccgtgatcgccctggaggacctgaactctggctttaagaatagccgcgtgaaggtggagaagcaggtgtatcagaagttcgagaagatgctgatcgataagctgaactacatggtggacaagaagtctaatccttgtgcaacaggcggcgccctgaagggctatcagatcaccaataagttcgagagctttaagtccatgtctacccagaacggcttcatcttttacatccctgcctggctgacatccaagatcgatccatctaccggctttgtgaacctgctgaaaaccaagtataccagcatcgccgattccaagaagttcatcagctcctttgacaggatcatgtacgtgcccgaggaggatctgttcgagtttgccctggactataagaacttctctcgcacagacgccgattacatcaagaagtggaagctgtactcctacggcaaccggatcagaatcttccggaatcctaagaagaacaacgtgttcgactgggaggaggtgtgcctgaccagcgcctataaggagctgttcaacaagtacggcatcaattatcagcagggcgatatcagagccctgctgtgcgagcagtccgacaaggccttctactctagctttatggccctgatgagcctgatgctgcagatgcggaacagcatcacaggccgcaccgacgtggattttctgatcagccctgtgaagaactccgacggcatcttctacgatagccggaactatgaggcccaggagaatgccatcctgccaaagaacgccgacgccaatggcgcctataacatcgccagaaaggtgctgtgggccatcggccagttcaagaaggccgaggacgagaagctggataaggtgaagatcgccatctctaacaaggagtggctggagtacgcccagaccagcgtgaagcacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 456 - protein, 1228 aa, Artificial Sequence; identical to SEQ ID NO: 109
  source: /note="Description of Artificial Sequence: Synthetic polypeptide"

SEQ ID NO: 457 - DNA, 3930 bp, Artificial Sequence
  source: /note="Description of Artificial Sequence: Synthetic polynucleotide"
ggtaccatggacagcctgaaggatttcaccaacctgtaccccgtgtccaagacactgcggtttgagctgaagcctgtgggcaagaccctggagaatatcgagaaggccggcatcctgaaggaggatgagcacagagccgagagctaccggagagtgaagaagatcatcgatacatatcacaaggtgttcatcgacagctccctggagaacatggccaagatgggcatcgagaatgagatcaaggccatgctgcagtccttttgcgagctgtataagaaggaccacaggaccgagggagaggacaaggccctggataagatcagggccgtgctgaggggcctgatcgtgggagccttcaccggcgtgtgcggccggcgggagaacacagtgcagaatgagaagtatgagagcctgtttaaggagaagctgatcaaggagatcctgccagatttcgtgctgtctacagaggccgagtccctgcccttttctgtggaggaggccaccagaagcctgaaggagttcgactcctttacatcttacttcgccggcttttatgagaaccggaagaatatctactctaccaagccccagagcacagccatcgcctatagactgatccacgagaacctgcctaagttcatcgataatatcctggtgtttcagaagatcaaggagccaatcgccaaggagctggagcacatcagggcagacttcagcgccggcggctacatcaagaaggatgagcgcctggaggacatcttttccctgaactactatatccacgtgctgtctcaggccggcatcgagaagtacaatgccctgatcggcaagatcgtgaccgagggcgatggcgagatgaagggcctgaacgagcacatcaacctgtataatcagcagaggggccgcgaggaccggctgccactgttcagacccctgtataagcagatcctgtctgatagggagcagctgtcctatctgccagagtctttcgagaaggacgaggagctgctgagggccctgaaggagttttacgatcacatcgcagaggacatcctgggaaggacccagcagctgatgacaagcatctccgagtacgatctgtcccggatctatgtgagaaacgatagccagctgaccgacatctccaagaagatgctgggcgattggaatgccatctacatggcccgggagagagcctatgaccacgagcaggcccccaagcgcatcacagccaagtacgagagggaccgcatcaaggccctgaagggcgaggagtctatcagcctggccaacctgaacagctgcatcgccttcctggacaacgtgagggattgtcgcgtggacacctatctgtctacactgggacagaaggagggacctcacggcctgagcaacctggtggagaacgtgttcgcctcctaccacgaggccgagcagctgctgtcttttccctatcctgaggagaacaatctgatccaggacaaggataacgtggtgctgatcaagaacctgctggataatatcagcgacctgcagaggttcctgaagccactgtggggcatgggcgatgagcccgacaaggatgagaggttttacggcgagtacaattatatcaggggcgccctggaccaggtcatccctctgtataacaaggtgcggaattatctgacccgcaagccatactccacacgcaaggtgaagctgaacttcggcaatagccagctgctgtccggctgggataggaacaaggagaaggacaattcttgcgtgatcctgcgcaagggccagaacttctacctggccatcatgaacaatcggcacaagcggagcttcgagaataagatgctgcccgagtataaggagggcgagccttacttcgagaagatggattataagtttctgccagaccccaacaagatgctgcccaaggtgttcctgtctaagaagggcatcgagatctacaagcctagcccaaagctgctggagcagtatggccacggcacccacaagaagggcgataccttcagcatggacgatctgcacgagctgatcgacttctttaagcactccatcgaggcccacgaggattggaagcagttcggctttaagttcagcgacaccgccacatacgagaacgtgagcagcttctaccgggaggtggaggaccagggctacaagctgtcttttagaaaggtgtccgagtcttacgtgtatagcctgatcgatcagggcaagctgtacctgttccagatctataacaaggactttagcccttgttccaagggcaccccaaatctgcacacactgtactggcggatgctgttcgatgagagaaacctggccgacgtgatctataagctggatggcaaggccgagatcttctttcgggagaagtccctgaagaatgaccacccaacccaccctgcaggcaagcccatcaagaagaagagccggcagaagaagggcgaggagagcctgttcgagtacgatctggtgaaggaccggagatataccatggataagtttcagttccacgtgccaatcacaatgaactttaagtgctctgccggcagcaaggtgaacgacatggtgaatgcccacatcagggaggccaaggacatgcacgtgatcggcatcgataggggcgagcgcaatctgctgtatatctgcgtgatcgacagccgcggcaccatcctggatcagatctccctgaacacaatcaatgacatcgattatcacgatctgctggagtccagggacaaggatcgccagcaggagcacaggaactggcagaccatcgagggcatcaaggagctgaagcagggctacctgtctcaggccgtgcaccgcatcgccgagctgatggtggcctataaggccgtggtggccctggaggacctgaacatgggcttcaagcggggcagacagaaggtggagagcagcgtgtaccagcagtttgagaagcagctgatcgacaagctgaattatctggtggataagaagaagcggcccgaggacatcggaggcctgctgagagcctaccagttcaccgcccctttcaagagctttaaggagatgggcaagcagaacggctttctgttctatatccctgcctggaacacatccaatatcgacccaaccacaggcttcgtgaacctgtttcacgtgcagtacgagaatgtggataaggccaagagcttctttcagaagttcgacagcatctcctacaaccctaagaaggattggtttgagttcgcctttgactataagaacttcaccaagaaggccgagggctctaggagcatgtggattctgtgcacccacggctcccggatcaagaacttcagaaattctcagaagaatggccagtgggatagcgaggagtttgccctgaccgaggccttcaagtccctgtttgtgcggtacgagatcgattataccgccgacctgaaaaccgccatcgtggacgagaagcagaaggatttctttgtggacctgctgaagctgttcaagctgaccgtgcagatgagaaactcctggaaggagaaggacctggattacctgatctctccagtggccggcgccgatggcaggttctttgacacacgcgagggcaataagagcctgcccaaggacgcagatgcaaacggagcctataatatcgccctgaagggcctgtgggcactgaggcagatcagacagacctccgagggcggcaagctgaagctggccatctctaacaaggagtggctgcagtttgtgcaggagagatcctacgagaaggacaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 458 - protein, 1260 aa, Artificial Sequence; identical to SEQ ID NO: 92
  source: /note="Description of Artificial Sequence: Synthetic polypeptide"

SEQ ID NO: 459 - DNA, 4119 bp, Artificial Sequence
  source: /note="Description of Artificial Sequence: Synthetic polynucleotide"
ggtaccatggagaactatcaggagttcaccaacctgtttcagctgaataagacactgagattcgagctgaagcccatcggcaagacctgcgagctgctggaggagggcaagatcttcgccagcggctcctttctggagaaggacaaggtgagggccgataacgtgagctacgtgaagaaggagatcgacaagaagcacaagatctttatcgaggagacactgagctccttctctatcagcaacgatctgctgaagcagtactttgactgctataatgagctgaaggccttcaagaaggactgtaagagcgatgaggaggaggtgaagaaaaccgccctgcgcaacaagtgtacctccatccagagggccatgcgcgaggccatctctcaggcctttctgaagagcccccagaagaagctgctggccatcaagaacctgatcgagaacgtgttcaaggccgacgagaatgtgcagcacttctccgagtttaccagctatttctccggctttgagacaaacagagagaatttctactctgacgaggagaagtccacatctatcgcctataggctggtgcacgataacctgcctatcttcatcaagaacatctacatcttcgagaagctgaaggagcagttcgacgccaagaccctgagcgagatcttcgagaactacaagctgtatgtggccggctctagcctggatgaggtgttctccctggagtactttaacaataccctgacacagaagggcatcgacaactataatgccgtgatcggcaagatcgtgaaggaggataagcaggagatccagggcctgaacgagcacatcaacctgtataatcagaagcacaaggaccggagactgcccttctttatctccctgaagaagcagatcctgtccgatcgggaggccctgtcttggctgcctgacatgttcaagaatgattctgaagtgatcaaggccctgaagggcttctacatcgaggacggctttgagaacaatgtgctgacacctctggccaccctgctgtcctctctggataagtacaacctgaatggcatctttatccgcaacaatgaggccctgagctccctgtcccagaacgtgtatcggaatttttctatcgacgaggccatcgatgccaacgccgagctgcagaccttcaacaattacgagctgatcgccaatgccctgcgcgccaagatcaagaaggagacaaagcagggccggaagtctttcgagaagtacgaggagtatatcgataagaaggtgaaggccatcgacagcctgtccatccaggagatcaacgagctggtggagaattacgtgagcgagtttaactctaatagcggcaacatgccaagaaaggtggaggactacttcagcctgatgaggaagggcgacttcggctccaacgatctgatcgaaaatatcaagaccaagctgagcgccgcagagaagctgctgggcacaaagtaccaggagacagccaaggacatcttcaagaaggatgagaactccaagctgatcaaggagctgctggacgccaccaagcagttccagcactttatcaagccactgctgggcacaggcgaggaggcagatcgggacctggtgttctacggcgattttctgcccctgtatgagaagtttgaggagctgaccctgctgtataacaaggtgcggaatagactgacacagaagccctattccaaggacaagatccgcctgtgcttcaacaagcctaagctgatgacaggctgggtggattccaagaccgagaagtctgacaacggcacacagtacggcggctatctgtttcggaagaagaatgagatcggcgagtacgattattttctgggcatctctagcaaggcccagctgttcagaaagaacgaggccgtgatcggcgactacgagaggctggattactatcagccaaaggccaataccatctacggctctgcctatgagggcgagaacagctacaaggaggacaagaagcggctgaacaaagtgatcatcgcctatatcgagcagatcaagcagacaaacatcaagaagtctatcatcgagtccatctctaagtatcctaatatcagcgacgatgacaaggtgaccccatcctctctgctggagaagatcaagaaggtgtctatcgacagctacaacggcatcctgtccttcaagtcttttcagagcgtgaacaaggaagtgatcgataacctgctgaaaaccatcagccccctgaagaacaaggccgagtttctggacctgatcaataaggattatcagatcttcaccgaggtgcaggccgtgatcgacgagatctgcaagcagaaaaccttcatctactttccaatctccaacgtggagctggagaaggagatgggcgataaggacaagcccctgtgcctgttccagatcagcaataaggatctgtccttcgccaagacctttagcgccaacctgcggaagaagagaggcgccgagaatctgcacacaatgctgtttaaggccctgatggagggcaaccaggataatctggacctgggctctggcgccatcttctacagagccaagagcctggacggcaacaagcccacacaccctgccaatgaggccatcaagtgtaggaacgtggccaataaggataaggtgtccctgttcacctacgacatctataagaacaggcgctacatggagaataagttcctgtttcacctgagcatcgtgcagaactataaggccgccaatgactccgcccagctgaacagctccgccaccgagtatatcagaaaggccgatgacctgcacatcatcggcatcgataggggcgagcgcaatctgctgtactattccgtgatcgatatgaagggcaacatcgtggagcaggactctctgaatatcatcaggaacaatgacctggagacagattaccacgacctgctggataagagggagaaggagcgcaaggccaaccggcagaattgggaggccgtggagggcatcaaggacctgaagaagggctacctgagccaggccgtgcaccagatcgcccagctgatgctgaagtataacgccatcatcgccctggaggatctgggccagatgtttgtgacccgcggccagaagatcgagaaggccgtgtaccagcagttcgagaagagcctggtggataagctgtcctacctggtggacaagaagcggccttataatgagctgggcggcatcctgaaggcctaccagctggcctctagcatcaccaagaacaattctgacaagcagaacggcttcctgttttatgtgccagcctggaatacaagcaagatcgatcccgtgaccggctttacagacctgctgcggcccaaggccatgaccatcaaggaggcccaggacttctttggcgccttcgataacatctcttacaatgacaagggctatttcgagtttgagacaaactacgacaagtttaagatcagaatgaagagcgcccagaccaggtggacaatctgcaccttcggcaatcggatcaagagaaagaaggataagaactactggaattatgaggaggtggagctgaccgaggagttcaagaagctgtttaaggacagcaacatcgattacgagaactgtaatctgaaggaggagatccagaacaaggacaatcgcaagttctttgatgacctgatcaagctgctgcagctgacactgcagatgcggaactccgatgacaagggcaatgattatatcatctctcctgtggccaacgccgagggccagttctttgactcccgcaatggcgataagaagctgccactggatgcagacgcaaacggagcctacaatatcgcccgcaagggcctgtggaacatccggcagatcaagcagaccaagaacgacaagaagctgaatctgagcatctcctctacagagtggctggatttcgtgcgggagaagccttacctgaagaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 460 - protein, 1323 aa, Artificial Sequence; identical to SEQ ID NO: 74
  source: /note="Description of Artificial Sequence: Synthetic polypeptide"

SEQ ID NO: 461 - DNA, 3888 bp, Artificial Sequence
  source: /note="Description of Artificial Sequence: Synthetic polynucleotide"
ggtaccatgaaaacccagcacttctttgaggacttcacaagcctgtactctctgagcaagaccatccggtttgagctgaagccaatcggcaagaccctggagaacatcaagaagaatggcctgatccggagagatgagcagagactggacgattacgagaagctgaagaaagtgatcgacgagtatcacgaggatttcatcgccaacatcctgagctccttttccttctctgaggagatcctgcagtcctacatccagaatctgagcgagtccgaggccagggccaagatcgagaaaaccatgcgcgacacactggccaaggccttctctgaggatgagaggtacaagagcatctttaagaaggagctggtgaagaaggacatccccgtgtggtgccctgcctataagagcctgtgcaagaagttcgataactttaccacatctctggtgcccttccacgagaacaggaagaacctgtataccagcaatgagatcacagcctctatcccttatcgcatcgtgcacgtgaacctgccaaagtttatccagaatatcgaggccctgtgcgagctgcagaagaagatgggcgccgacctgtacctggagatgatggagaacctgcgcaacgtgtggcccagcttcgtgaaaaccccagacgacctgtgcaacctgaaaacctataatcacctgatggtgcagtctagcatcagcgagtacaacaggtttgtgggcggctattccaccgaggacggcacaaagcaccagggcatcaacgagtggatcaatatctacagacagaggaataaggagatgcgcctgcctggcctggtgttcctgcacaagcagatcctggccaaggtggactcctctagcttcatcagcgatacactggagaacgacgatcaggtgttttgcgtgctgagacagttcaggaagctgttttggaataccgtgtcctctaaggaggacgatgccgcctccctgaaggacctgttctgtggcctgtctggctatgaccctgaggccatctacgtgagcgatgcccacctggccacaatctccaagaacatctttgacagatggaattacatctccgatgccatcaggcgcaagaccgaggtgctgatgccacggaagaaggagagcgtggagagatatgccgagaagatctccaagcagatcaagaagagacagtcttacagcctggccgagctggacgatctgctggcccactatagcgaggagtccctgcccgcaggcttctctctgctgagctactttacatctctgggcggccagaagtatctggtgagcgacggcgaagtgatcctgtacgaggagggcagcaacatctgggacgaggtgctgatcgccttcagggatctgcaggtcatcctggacaaggacttcaccgagaagaagctgggcaaggatgaggaggccgtgtctgtgatcaagaaggccctggacagcgccctgcgcctgcggaagttctttgatctgctgtccggcacaggcgcagagatcaggagagacagctccttctatgccctgtataccgaccggatggataagctgaagggcctgctgaagatgtatgataaggtgagaaactacctgaccaagaagccttattccatcgagaagttcaagctgcactttgacaacccatccctgctgtctggctgggataagaataaggagctgaacaatctgtctgtgatcttccggcagaacggctactattacctgggcatcatgacacccaagggcaagaatctgttcaagaccctgcctaagctgggcgccgaggagatgttttatgagaagatggagtacaagcagatcgccgagcctatgctgatgctgccaaaggtgttctttcccaagaaaaccaagccagccttcgccccagaccagagcgtggtggatatctacaacaagaaaaccttcaagacaggccagaagggctttaataagaaggacctgtaccggctgatcgacttctacaaggaggccctgacagtgcacgagtggaagctgtttaacttctccttttctccaaccgagcagtatcggaatatcggcgagttctttgacgaggtgagagagcaggcctacaaggtgtccatggtgaacgtgcccgcctcttatatcgacgaggccgtggagaacggcaagctgtatctgttccagatctacaataaggacttcagcccctactccaagggcatccctaacctgcacacactgtattggaaggccctgttcagcgagcagaatcagagccgggtgtataagctgtgcggaggaggagagctgttttatagaaaggccagcctgcacatgcaggacaccacagtgcaccccaagggcatctctatccacaagaagaacctgaataagaagggcgagacaagcctgttcaactacgacctggtgaaggataagaggtttaccgaggacaagttctttttccacgtgcctatctctatcaactacaagaataagaagatcaccaacgtgaatcagatggtgcgcgattatatcgcccagaacgacgatctgcagatcatcggcatcgaccgcggcgagcggaatctgctgtatatcagccggatcgatacaaggggcaacctgctggagcagttcagcctgaatgtgatcgagtccgacaagggcgatctgagaaccgactatcagaagatcctgggcgatcgcgagcaggagcggctgaggcgccggcaggagtggaagtctatcgagagcatcaaggacctgaaggatggctacatgagccaggtggtgcacaagatctgtaacatggtggtggagcacaaggccatcgtggtgctggagaacctgaatctgagcttcatgaagggcaggaagaaggtggagaagtccgtgtacgagaagtttgagcgcatgctggtggacaagctgaactatctggtggtggataagaagaacctgtccaatgagccaggaggcctgtatgcagcataccagctgaccaatccactgttctcttttgaggagctgcacagatacccccagagcggcatcctgtttttcgtggacccatggaacacctctctgacagatcccagcacaggcttcgtgaatctgctgggcagaatcaactacaccaatgtgggcgacgcccgcaagtttttcgatcggtttaacgccatcagatatgacggcaagggcaatatcctgttcgacctggatctgtccagatttgatgtgagggtggagacacagaggaagctgtggacactgaccacattcggctctcgcatcgccaaatccaagaagtctggcaagtggatggtggagcggatcgagaacctgagcctgtgctttctggagctgttcgagcagtttaatatcggctacagagtggagaaggacctgaagaaggccatcctgagccaggataggaaggagttctatgtgcgcctgatctacctgtttaacctgatgatgcagatccggaacagcgacggcgaggaggattatatcctgtctcccgccctgaacgagaagaatctgcagttcgacagcaggctgatcgaggccaaggatctgcctgtggacgcagatgcaaacggagcatacaatgtggcccgcaagggcctgatggtggtgcagagaatcaagaggggcgaccacgagtccatccacaggatcggaagggcacagtggctgagatatgtgcaggagggcatcgtggagaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattc

SEQ ID NO: 462 - protein, 1246 aa, Artificial Sequence; identical to SEQ ID NO: 102
  source: /note="Description of Artificial Sequence: Synthetic polypeptide"

SEQ ID NO: 463 - RNA, 36 nt, Artificial Sequence; identical to SEQ ID NO: 49
  source: /note="Description of Artificial Sequence: Synthetic oligonucleotide"

SEQ ID NO: 464 - RNA, 36 nt, Artificial Sequence; identical to SEQ ID NO: 49
  source: /note="Description of Artificial Sequence: Synthetic oligonucleotide"

SEQ ID NO: 465 - RNA, 35 nt, Artificial Sequence
  source: /note="Description of Artificial Sequence: Synthetic oligonucleotide"
gcuauaaugccuauauaauuucuacuauuguagau

SEQ ID NO: 466 - RNA, 35 nt, Artificial Sequence; identical to SEQ ID NO: 465
  source: /note="Description of Artificial Sequence: Synthetic oligonucleotide"

SEQ ID NO: 467 - RNA, 36 nt, Artificial Sequence
  source: /note="Description of Artificial Sequence: Synthetic oligonucleotide"
gccuauaaggcuuuaguaauuucuacuauuguagau

SEQ ID NO: 468 - RNA, 36 nt, Artificial Sequence
  source: /note="Description of Artificial Sequence: Synthetic oligonucleotide"
guuuuggaguaccuuagaaaugcaugguucucaugc

SEQ ID NO: 469 - RNA, 36 nt, Artificial Sequence
  source: /note="Description of Artificial Sequence: Synthetic oligonucleotide"
gucaauaagacucauuuaauuucuacuucgguagau

SEQ ID NO: 470 - RNA, 35 nt, Artificial Sequence
  source: /note="Description of Artificial Sequence: Synthetic oligonucleotide"
guuuuagaaccuuaaaaauuaccuaguaauuaggu

SEQ ID NO: 471 - RNA, 36 nt, Artificial Sequence
  source: /note="Description of Artificial Sequence: Synthetic oligonucleotide"
gucuagguacucucuuuaauuucuacuauuguagau

SEQ ID NO: 472 - RNA, 36 nt, Artificial Sequence
  source: /note="Description of Artificial Sequence: Synthetic oligonucleotide"
guuuaaaaguccuauuggauuucuacuuuuguagau

SEQ ID NO: 473 - RNA, 36 nt, Artificial Sequence
  source: /note="Description of Artificial Sequence: Synthetic oligonucleotide"
guuucaaagauuaaauaauuucuacuaaguguagau

SEQ ID NO: 474 - RNA, 36 nt, Artificial Sequence
  source: /note="Description of Artificial Sequence: Synthetic oligonucleotide"
gccaaauaccucuauaaaauuucuacuuuuguagau

SEQ ID NO: 475 - RNA, 36 nt, Artificial Sequence
  source: /note="Description of Artificial Sequence: Synthetic oligonucleotide"
cucuaaagagaggaaagaauuucuacuuuuguagau

SEQ ID NO: 476 - RNA, 32 nt, Artificial Sequence
  source: /note="Description of Artificial Sequence: Synthetic oligonucleotide"
guuucaauccacgcgcccacgcggggcgcgac

SEQ ID NO: 477 - RNA, 36 nt, Artificial Sequence
  source: /note="Description of Artificial Sequence: Synthetic oligonucleotide"
gucuaacgaccuuuuaaauuucuacuguuuguagau

SEQ ID NO: 478 - RNA, 35 nt, Artificial Sequence
  source: /note="Description of Artificial Sequence: Synthetic oligonucleotide"
gucaaaagaccuuuuuaauuucuacucuuguagau

SEQ ID NO: 479 - RNA, 36 nt, Artificial Sequence
  source: /note="Description of Artificial Sequence: Synthetic oligonucleotide"
guuugaauaaccuuaaauaauuucuacuuuguagau

SEQ ID NO: 480 - RNA, 36 nt, Artificial Sequence
  source: /note="Description of Artificial Sequence: Synthetic oligonucleotide"
gcuuagaacauuuaaagaauuucuacuauuguagau

SEQ ID NO: 481 - RNA, 35 nt, Artificial Sequence
  source: /note="Description of Artificial Sequence: Synthetic oligonucleotide"
cucaaaacucauucgaaucucuacucuuuguagau

SEQ ID NO: 482 - RNA, 35 nt, Artificial Sequence; identical to SEQ ID NO: 481
  source: /note="Description of Artificial Sequence: Synthetic oligonucleotide"

SEQ ID NO: 483 - RNA, 36 nt, Artificial Sequence; identical to SEQ ID NO: 480
  source: /note="Description of Artificial Sequence: Synthetic oligonucleotide"

SEQ ID NO: 484 - RNA, 36 nt, Artificial Sequence; identical to SEQ ID NO: 479
  source: /note="Description of Artificial Sequence: Synthetic oligonucleotide"

SEQ ID NO: 485 - RNA, 35 nt, Artificial Sequence; identical to SEQ ID NO: 478
  source: /note="Description of Artificial Sequence: Synthetic oligonucleotide"

SEQ ID NO: 486 - RNA, 36 nt, Artificial Sequence; identical to SEQ ID NO: 477
  source: /note="Description of Artificial Sequence: Synthetic oligonucleotide"

SEQ ID NO: 487 - RNA, 32 nt, Artificial Sequence; identical to SEQ ID NO: 476
  source: /note="Description of Artificial Sequence: Synthetic oligonucleotide"

SEQ ID NO: 488 - RNA, 36 nt, Artificial Sequence; identical to SEQ ID NO: 475
  source: /note="Description of Artificial Sequence: Synthetic oligonucleotide"

SEQ ID NO: 489 - RNA, 36 nt, Artificial Sequence; identical to SEQ ID NO: 474
  source: /note="Description of Artificial Sequence: Synthetic oligonucleotide"

SEQ ID NO: 490 - RNA, 36 nt, Artificial Sequence; identical to SEQ ID NO: 473
  source: /note="Description of Artificial Sequence: Synthetic oligonucleotide"

SEQ ID NO: 491 - RNA, 36 nt, Artificial Sequence; identical to SEQ ID NO: 472
  source: /note="Description of Artificial Sequence: Synthetic oligonucleotide"

SEQ ID NO: 492 - RNA, 36 nt, Artificial Sequence; identical to SEQ ID NO: 471
  source: /note="Description of Artificial Sequence: Synthetic oligonucleotide"

SEQ ID NO: 493 - RNA, 35 nt, Artificial Sequence; identical to SEQ ID NO: 470
  source: /note="Description of Artificial Sequence: Synthetic oligonucleotide"

SEQ ID NO: 494 - RNA, 36 nt, Artificial Sequence; identical to SEQ ID NO: 469
  source: /note="Description of Artificial Sequence: Synthetic oligonucleotide"

SEQ ID NO: 495 - RNA, 36 nt, Artificial Sequence; identical to SEQ ID NO: 468
  source: /note="Description of Artificial Sequence: Synthetic oligonucleotide"

SEQ ID NO: 496 - RNA, 36 nt, Artificial Sequence; identical to SEQ ID NO: 467
  source: /note="Description of Artificial Sequence: Synthetic oligonucleotide"

SEQ ID NO: 497 - RNA, 77 nt, Artificial Sequence
  source: /note="Description of Artificial Sequence: Synthetic oligonucleotide"
gggacuuuaaauaauuucuacuguuguagauaggccccaguggcugcucugggggccuccgucuaagaacuuuaaau

SEQ ID NO: 498 - RNA, 77 nt, Artificial Sequence
  source: /note="Description of Artificial Sequence: Synthetic oligonucleotide"
gggacuuuaaauaauuucuacuguuguagauucaucugugccccucccucccuggcccaggucuaagaacuuuaaau

SEQ ID NO: 499 - RNA, 77 nt, Artificial Sequence
  source: /note="Description of Artificial Sequence: Synthetic oligonucleotide"
gggacuuuaaauaauuucuacuguuguagaugugguugcccacccuagucauuggagguggucuaagaacuuuaaau

SEQ ID NO: 500 - RNA, 77 nt, Artificial Sequence
  source: /note="Description of Artificial Sequence: Synthetic oligonucleotide"
gggacuuuaaauaauuucuacuguuguagauggggccccaggccgggguccccucugaccgucuaagaacuuuaaau

SEQ ID NO: 501 - DNA, 639 bp, Artificial Sequence
  source: /note="Description of Artificial Sequence: Synthetic polynucleotide"
ccatccccttctgtgaatgttagacccatgggagcagctggtcagaggggaccccggcctggggcccctaaccctatgtagcctcagtcttcccatcaggctctcagctcagcctgagtgttgaggccccagtggctgctctgggggcctcctgagtttctcatctgtgcccctccctccctggcccaggtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactagggtgggcaaccacaaacccacgagggcagagtgctgcttgctgctggccaggcccctgcgtgggcccaagctggactctggccactccctggccaggctttggggaggcctggagtcatggccccacagggcttgaagcccggggccgccattgacagagggacaagcaatgggctggctgaggcctgggaccacttggccttctcctcggagagcctgcctgcctgggcgggcccgcccgccaccgcagcctcccagctgctctccgtgtctccaatctcc

SEQ ID NO: 502 - RNA, 106 nt, Artificial Sequence
  source: /note="Description of Artificial Sequence: Synthetic polynucleotide"
ggggucuaagaacuuuaaauaauuucuacuguuguagaugagaagucauuuaauaaggccacuguuaaaagucuaagaacuuuaaauaauuucuacuguuguagau

SEQ ID NO: 503 - RNA, 100 nt, Artificial Sequence
  source: /note="Description of Artificial Sequence: Synthetic polynucleotide"
ggggaacuuuaaauaauuucuacuguuguagaugagaagucauuuaauaaggccacuguuaaaagucuaagaacuuuaaauaauuucuacuguuguagau

SEQ ID NO: 504 - RNA, 94 nt, Artificial Sequence
  source: /note="Description of Artificial Sequence: Synthetic oligonucleotide"
ggguaaauaauuucuacuguuguagaugagaagucauuuaauaaggccacuguuaaaagucuaagaacuuuaaauaauuucuacuguuguagau

SEQ ID NO: 505 - RNA, 88 nt, Artificial Sequence
  source: /note="Description of Artificial Sequence: Synthetic oligonucleotide"
gggauuucuacuguuguagaugagaagucauuuaauaaggccacuguuaaaagucuaagaacuuuaaauaauuucuacuguuguagau

SEQ ID NO: 506 - RNA, 82 nt, Artificial Sequence
  source: /note="Description of Artificial Sequence: Synthetic oligonucleotide"
gggacuguuguagaugagaagucauuuaauaaggccacuguuaaaagucuaagaacuuuaaauaauuucuacuguuguagau

SEQ ID NO: 507 - RNA, 36 nt, Artificial Sequence; identical to SEQ ID NO: 49
  source: /note="Description of Artificial Sequence: Synthetic oligonucleotide"

SEQ ID NO: 508 - DNA, 79 bp, Artificial Sequence
  source: /note="Description of Artificial Sequence: Synthetic oligonucleotide"
gggactttaaataatttctactgttgtagattagaagtcatttaataaggccactgttaaaagtctaagaactttaaat

SEQ ID NO: 509 - DNA, 79 bp, Artificial Sequence
  source: /note="Description of Artificial Sequence: Synthetic oligonucleotide"
gggactttaaataatttctactgttgtagatgaggagtcatttaataaggccactgttaaaagtctaagaactttaaat

SEQ ID NO: 510 - DNA, 79 bp, Artificial Sequence
  source: /note="Description of Artificial Sequence: Synthetic oligonucleotide"
gggactttaaataatttctactgttgtagatgagaagccatttaataaggccactgttaaaagtctaagaactttaaat

SEQ ID NO: 511 - DNA, 79 bp, Artificial Sequence
  source: /note="Description of Artificial Sequence: Synthetic oligonucleotide"
gggactttaaataatttctactgttgtagatgagaagtcaattaataaggccactgttaaaagtctaagaactttaaat

SEQ ID NO: 512 - DNA, 79 bp, Artificial Sequence
  source: /note="Description of Artificial Sequence: Synthetic oligonucleotide"
gggactttaaataatttctactgttgtagatgagaagtcattttataaggccactgttaaaagtctaagaactttaaat

SEQ ID NO: 513 - DNA, 79 bp, Artificial Sequence
  source: /note="Description of Artificial Sequence: Synthetic oligonucleotide"
gggactttaaataatttctactgttgtagatgagaagtcatttaatgaggccactgttaaaagtctaagaactttaaat

SEQ ID NO: 514 - DNA, 79 bp, Artificial Sequence
  source: /note="Description of Artificial Sequence: Synthetic oligonucleotide"
gggactttaaataatttctactgttgtagatgagaagtcatttaataagcccactgttaaaagtctaagaactttaaat

SEQ ID NO: 515 - DNA, 79 bp, Artificial Sequence
  source: /note="Description of Artificial Sequence: Synthetic oligonucleotide"
gggactttaaataatttctactgttgtagatgagaagtcatttaataaggcctctgttaaaagtctaagaactttaaat

SEQ ID NO: 516 - DNA, 79 bp, Artificial Sequence
  source: /note="Description of Artificial Sequence: Synthetic oligonucleotide"
gggactttaaataatttctactgttgtagatgagaagtcatttaataaggccactattaaaagtctaagaactttaaat

SEQ ID NO: 517 - DNA, 79 bp, Artificial Sequence
  source: /note="Description of Artificial Sequence: Synthetic oligonucleotide"
gggactttaaataatttctactgttgtagatgagaagtcatttaataaggccactgtttaaagtctaagaactttaaat

SEQ ID NO: 518 - DNA, 79 bp, Artificial Sequence
  source: /note="Description of Artificial Sequence: Synthetic oligonucleotide"
gggactttaaataatttctactgttgtagatgagaagtcatttaataaggccactgttaaaggtctaagaactttaaat

SEQ ID NO: 519 - RNA, 76 nt, Artificial Sequence
  source: /note="Description of Artificial Sequence: Synthetic oligonucleotide"
acuuuaaauaauuucuacuguuguagaugagaagucauuuaauaaggccacuguuaaaagucuaagaacuuuaaau

SEQ ID NO: 520 - RNA, 36 nt, Artificial Sequence; identical to SEQ ID NO: 49
  source: /note="Description of Artificial Sequence: Synthetic oligonucleotide"

SEQ ID NO: 521 - RNA, 35 nt, Artificial Sequence; identical to SEQ ID NO: 465
  source: /note="Description of Artificial Sequence: Synthetic oligonucleotide"

SEQ ID NO: 522 - RNA, 43 nt, Artificial Sequence
  source: /note="Description of Artificial Sequence: Synthetic oligonucleotide"
  modified_base (20)..(43): a, c, u, g, unknown or other
  misc_feature (40)..(43): May or may not be present
aauuucuacuguuguagaunnnnnnnnnnnnnnnnnnnnnnnn

SEQ ID NO: 523 - RNA, 43 nt, Artificial Sequence; identical to SEQ ID NO: 522
  source: /note="Description of Artificial Sequence: Synthetic oligonucleotide"
  modified_base (20)..(43): a, c, u, g, unknown or other

SEQ ID NO: 524 - RNA, 43 nt, Artificial Sequence
  source: /note="Description of Artificial Sequence: Synthetic oligonucleotide"
  modified_base (20)..(43): a, c, u, g, unknown or other
  misc_feature (40)..(43): May or may not be present
aauuucuacuauuguagaunnnnnnnnnnnnnnnnnnnnnnnn

SEQ ID NO: 525 - RNA, 43 nt, Artificial Sequence; identical to SEQ ID NO: 524
  source: /note="Description of Artificial Sequence: Synthetic oligonucleotide"
  modified_base (20)..(43): a, c, u, g, unknown or other

SEQ ID NO: 526 - DNA, 21 bp, Artificial Sequence
  source: /note="Description of Artificial Sequence: Synthetic oligonucleotide"
ttaataaggccactgttaaaa

SEQ ID NO: 527 - DNA, 14 bp, Artificial Sequence
  source: /note="Description of Artificial Sequence: Synthetic oligonucleotide"
  modified_base (14)..(14): a, c, t, g, unknown or other
ttaataaggccacn

SEQ ID NO: 528 - DNA, 13 bp, Artificial Sequence
  source: /note="Description of Artificial Sequence: Synthetic oligonucleotide"
gccactgttaaaa

SEQ ID NO: 529 - RNA, 43 nt, Artificial Sequence
  source: /note="Description of Artificial Sequence: Synthetic oligonucleotide"
aauuucuacuuguguagaugagaagucauuuaauaaggccacu

SEQ ID NO: 530 - RNA, 22 nt, Artificial Sequence
  source: /note="Description of Artificial Sequence: Synthetic oligonucleotide"
gagaagucauuuaauaaggcca

SEQ ID NO: 531 - RNA, 20 nt, Artificial Sequence
  source: /note="Description of Artificial Sequence: Synthetic oligonucleotide"
gagaagucauuuaauaaggc

SEQ ID NO: 532 - RNA, 18 nt, Artificial Sequence
  source: /note="Description of Artificial Sequence: Synthetic oligonucleotide"
gagaagucauuuaauaag

SEQ ID NO: 533 - RNA, 17 nt, Artificial Sequence
  source: /note="Description of Artificial Sequence: Synthetic oligonucleotide"
gagaagucauuuaauaa

SEQ ID NO: 534 - RNA, 16 nt, Artificial Sequence
  source: /note="Description of Artificial Sequence: Synthetic oligonucleotide"
gagaagucauuuaaua

SEQ ID NO: 535 - RNA, 15 nt, Artificial Sequence
  source: /note="Description of Artificial Sequence: Synthetic oligonucleotide"
gagaagucauuuaau

SEQ ID NO: 536 - DNA, 68 bp, Artificial Sequence
  source: /note="Description of Artificial Sequence: Synthetic oligonucleotide"
gaattatctgaaggcacaggaatagtagcatctacaacagtagaaattatttaaagttcttagacttt

SEQ ID NO: 537 - DNA, 36 bp, Artificial Sequence
  source: /note="Description of Artificial Sequence: Synthetic oligonucleotide"
atctacaacagtagaaattatttaaagttcttagac

SEQ ID NO: 538 - DNA, 42 bp, Artificial Sequence
  source: /note="Description of Artificial Sequence: Synthetic oligonucleotide"
tctgaaggcacaggaatagtagcatctacaacagtagaaatt

SEQ ID NO: 539 - DNA, 42 bp, Artificial Sequence; identical to SEQ ID NO: 538
  source: /note="Description of Artificial Sequence: Synthetic oligonucleotide"

SEQ ID NO: 540 - DNA, 42 bp, Artificial Sequence; identical to SEQ ID NO: 538
  source: /note="Description of Artificial Sequence: Synthetic oligonucleotide"

SEQ ID NO: 541 - DNA, 13 bp, Artificial Sequence
  source: /note="Description of Artificial Sequence: Synthetic oligonucleotide"
atctacaacagta

SEQ ID NO: 542 - DNA, 13 bp, Artificial Sequence
  source: /note="Description of Artificial Sequence: Synthetic oligonucleotide"
atctacaacagta

SEQ ID NO: 543 - DNA, 13 bp, Artificial Sequence
  source: /note="Description of Artificial Sequence: Synthetic oligonucleotide"
atctacaacagta

SEQ ID NO: 544 - DNA, 13 bp, Artificial Sequence
  source: /note="Description of Artificial Sequence: Synthetic oligonucleotide"
atctacaacagta

SEQ ID NO: 545 - DNA, 13 bp, Artificial Sequence
  source: /note="Description of Artificial Sequence: Synthetic oligonucleotide"
atctacaacagta

SEQ ID NO: 546 - DNA, 13 bp, Artificial Sequence
  source: /note="Description of Artificial Sequence: Synthetic oligonucleotide"
atctacaacagta

SEQ ID NO: 547 - DNA, 77 bp, Artificial Sequence
  source: /note="Description of Artificial Sequence: Synthetic oligonucleotide"
agacttttaacagtggccttattaaatgacttctcatctacaacagtagaaattatttaaagttcttagacccgttt

SEQ ID NO: 548 - DNA, 36 bp, Artificial Sequence; identical to SEQ ID NO: 537
  source: /note="Description of Artificial Sequence: Synthetic oligonucleotide"

SEQ ID NO: 549 - DNA, 14 bp, Artificial Sequence
  source: /note="Description of Artificial Sequence: Synthetic oligonucleotide"
agacttttaacagt

SEQ ID NO: 550 - DNA, 18 bp, Artificial Sequence
  source: /note="Description of Artificial Sequence: Synthetic oligonucleotide"
aatgacttctcatctaca

SEQ ID NO: 551 - DNA, 19 bp, Artificial Sequence
  source: /note="Description of Artificial Sequence: Synthetic oligonucleotide"
atttaaagttcttagaccc

SEQ ID NO: 552 - DNA, 14 bp, Artificial Sequence
  source: /note="Description of Artificial Sequence: Synthetic oligonucleotide"
agacttttaacagt

SEQ ID NO: 553 - DNA, 24 bp, Artificial Sequence
  source: /note="Description of Artificial Sequence: Synthetic oligonucleotide"
aatgacttctcatctacaacagta

SEQ ID NO: 554 - DNA, 17 bp, Artificial Sequence
  source: /note="Description of Artificial Sequence: Synthetic oligonucleotide"
agttcttagacccgttt

SEQ ID NO: 555 - DNA, 26 bp, Artificial Sequence
  source: /note="Description of Artificial Sequence: Synthetic oligonucleotide"
gacttttaacagtggccttattaaat

SEQ ID NO: 556 - DNA, 40 bp, Artificial Sequence
  source: /note="Description of Artificial Sequence: Synthetic oligonucleotide"
ctacaacagtagaaattatttaaagttcttagacccgttt

SEQ ID NO: 557 - DNA, 19 bp, Artificial Sequence
  source: /note="Description of Artificial Sequence: Synthetic oligonucleotide"
agacttttaacagtggcct

SEQ ID NO: 558 - DNA, 18 bp, Artificial Sequence
  source: /note="Description of Artificial Sequence: Synthetic oligonucleotide"
cttctcatctacaacagt

SEQ ID NO: 559 - DNA, 17 bp, Artificial Sequence
  source: /note="Description of Artificial Sequence: Synthetic oligonucleotide"
agttcttagacccgttt

SEQ ID NO: 560 - DNA, 16 bp, Artificial Sequence
  source: /note="Description of Artificial Sequence: Synthetic oligonucleotide"
cttattaaatgacttc

SEQ ID NO: 561 - DNA, 32 bp, Artificial Sequence
  source: /note="Description of Artificial Sequence: Synthetic oligonucleotide"
gtagaaattatttaaagttcttagacccgttt

SEQ ID NO: 562 - DNA, 35 bp, Artificial Sequence
  source: /note="Description of Artificial Sequence: Synthetic oligonucleotide"
agacttttaacagtggccttattaaatgacttctc

SEQ ID NO: 563 - DNA, 31 bp, Artificial Sequence
  source: /note="Description of Artificial Sequence: Synthetic oligonucleotide"
tagaaattatttaaagttcttagacccgttt

SEQ ID NO: 564 - DNA, 13 bp, Artificial Sequence
  source: /note="Description of Artificial Sequence: Synthetic oligonucleotide"
agacttttaacag

SEQ ID NO: 565 - DNA, 24 bp, Artificial Sequence
  source: /note="Description of Artificial Sequence: Synthetic oligonucleotide"
aaatgacttctgatctacaacagt

SEQ ID NO: 566 - DNA, 16 bp, Artificial Sequence
  source: /note="Description of Artificial Sequence: Synthetic oligonucleotide"
gttcttagacccgttt

SEQ ID NO: 567 - DNA, 21 bp, Artificial Sequence
  source: /note="Description of Artificial Sequence: Synthetic oligonucleotide"
agacttttaacagtggcctta

SEQ ID NO: 568 - DNA, 18 bp, Artificial Sequence
  source: /note="Description of Artificial Sequence: Synthetic oligonucleotide"
tctcatctacaacagtag

SEQ ID NO: 569 - DNA, 16 bp, Artificial Sequence
  source: /note="Description of Artificial Sequence: Synthetic oligonucleotide"
gttcttagacccgttt

SEQ ID NO: 570 - DNA, 10 bp, Artificial Sequence
  source: /note="Description of Artificial Sequence: Synthetic oligonucleotide"
agacttttaa

SEQ ID NO: 571 - DNA, 24 bp, Artificial Sequence
  source: /note="Description of Artificial Sequence: Synthetic oligonucleotide"
attaaatgacttctcatctacaac

SEQ ID NO: 572 - DNA, 21 bp, Artificial Sequence
  source: /note="Description of Artificial Sequence: Synthetic oligonucleotide"
ttaaagttcttagacccgttt

SEQ ID NO: 573 - DNA, 14 bp, Artificial Sequence
  source: /note="Description of Artificial Sequence: Synthetic oligonucleotide"
agacttttaacagt

SEQ ID NO: 574 - DNA, 25 bp, Artificial Sequence
  source: /note="Description of Artificial Sequence: Synthetic oligonucleotide"
aatgacttctcatctacaacagtag

SEQ ID NO: 575 - DNA, 14 bp, Artificial Sequence
  source: /note="Description of Artificial Sequence: Synthetic oligonucleotide"
tcttagacccgttt

SEQ ID NO: 576 - DNA, 40 bp, Artificial Sequence
  source: /note="Description of Artificial Sequence: Synthetic oligonucleotide"
agacttttaacagtggccttattaaatgacttctcatcta

SEQ ID NO: 577 - DNA, 27 bp, Artificial Sequence
  source: /note="Description of Artificial Sequence: Synthetic oligonucleotide"
aattatttaaagttcttagacccgttt

SEQ ID NO: 578 - DNA, 16 bp, Artificial Sequence
  source: /note="Description of Artificial Sequence: Synthetic oligonucleotide"
agacttttaacagtgg

SEQ ID NO: 579 - DNA, 18 bp, Artificial Sequence
  source: /note="Description of Artificial Sequence: Synthetic oligonucleotide"
tgacttctcatctacaac

SEQ ID NO: 580 - DNA, 21 bp, Artificial Sequence
  source: /note="Description of Artificial Sequence: Synthetic oligonucleotide"
ttaaagttcttagacccgttt

SEQ ID NO: 581 - DNA, 13 bp, Artificial Sequence
  source: /note="Description of Artificial Sequence: Synthetic oligonucleotide"
agacttttaacag

SEQ ID NO: 582 - DNA, 24 bp, Artificial Sequence
  source: /note="Description of Artificial Sequence: Synthetic oligonucleotide"
aaatgacttctcatctacaacagt

SEQ ID NO: 583 - DNA, 14 bp, Artificial Sequence
  source: /note="Description of Artificial Sequence: Synthetic oligonucleotide"
tcttagacccgttt

SEQ ID NO: 584 - DNA, 32 bp, Artificial Sequence
  source: /note="Description of Artificial Sequence: Synthetic oligonucleotide"
atctacaacagtagaaattatttaaagttctt

SEQ ID NO: 585 - DNA, 43 bp, Artificial Sequence
  source: /note="Description of Artificial Sequence: Synthetic oligonucleotide"
aatttctactgttgtagatgagaagtcatttaataaggccact

SEQ ID NO: 586 - DNA, 65 bp, Artificial Sequence
  source: /note="Description of Artificial Sequence: Synthetic oligonucleotide"
ggtacccggggatcctttagagaagtcatttaataaggccactgttaaaaagcttggcgtaatca

SEQ ID NO: 587 - RNA, 43 nt, Artificial Sequence
  source: /note="Description of Artificial Sequence: Synthetic oligonucleotide"
aauuucuacuguuguagaugagaagucauuuaauaaggccacu

SEQ ID NO: 588 - DNA, 21 bp, Artificial Sequence
  source: /note="Description of Artificial Sequence: Synthetic oligonucleotide"
ttaataaggccactgttaaaa

SEQ ID NO: 589 - DNA, 14 bp, Artificial Sequence
  source: /note="Description of Artificial Sequence: Synthetic primer"
  modified_base (1)..(1): a, c, t, g, unknown or other
ngccactgttaaaa

SEQ ID NO: 590 - DNA, 14 bp, Artificial Sequence
  source: /note="Description of Artificial Sequence: Synthetic primer"
  modified_base (14)..(14): a, c, t, g, unknown or other
ttaataaggccacn

SEQ ID NO: 591 - RNA, 43 nt, Artificial Sequence; identical to SEQ ID NO: 587
  source: /note="Description of Artificial Sequence: Synthetic oligonucleotide"

SEQ ID NO: 592 - RNA, 22 nt, Artificial Sequence
  source: /note="Description of Artificial Sequence: Synthetic oligonucleotide"
gagaagucauuuaauaaggcca

SEQ ID NO: 593 - RNA, 20 nt, Artificial Sequence
  source: /note="Description of Artificial Sequence: Synthetic oligonucleotide"
gagaagucauuuaauaaggc

SEQ ID NO: 594 - RNA, 18 nt, Artificial Sequence
  source: /note="Description of Artificial Sequence: Synthetic oligonucleotide"
gagaagucauuuaauaag

SEQ ID NO: 595 - RNA, 17 nt, Artificial Sequence
  source: /note="Description of Artificial Sequence: Synthetic oligonucleotide"
gagaagucauuuaauaa

SEQ ID NO: 596 - RNA, 16 nt, Artificial Sequence
  source: /note="Description of Artificial Sequence: Synthetic oligonucleotide"
gagaagucauuuaaua

SEQ ID NO: 597 - RNA, 15 nt, Artificial Sequence
  source: /note="Description of Artificial Sequence: Synthetic oligonucleotide"
gagaagucauuuaau

SEQ ID NO: 598 - RNA, 43 nt, Artificial Sequence; identical to SEQ ID NO: 587
  source: /note="Description of Artificial Sequence: Synthetic oligonucleotide"

SEQ ID NO: 599 - DNA, 24 bp, Artificial Sequence
  source: /note="Description of Artificial Sequence: Synthetic oligonucleotide"
  source: /note="Description of Combined DNA/RNA Molecule: Synthetic oligonucleotide"
gataagucauuuaauaaggccacu

SEQ ID NO: 600 - RNA, 24 nt, Artificial Sequence
  source: /note="Description of Artificial Sequence: Synthetic oligonucleotide"
gagaaggcauuuaauaaggccacu

SEQ ID NO: 601 - RNA, 24 nt, Artificial Sequence
  source: /note="Description of Artificial Sequence: Synthetic oligonucleotide"
gagaagucauguaauaaggccacu

SEQ ID NO: 602 - RNA, 24 nt, Artificial Sequence
  source: /note="Description of Artificial Sequence: Synthetic oligonucleotide"
gagaagucauuuaagaaggccacu

SEQ ID NO: 603 - DNA, 24 bp, Artificial Sequence
  source: /note="Description of Artificial Sequence: Synthetic oligonucleotide"
  source: /note="Description of Combined DNA/RNA Molecule: Synthetic oligonucleotide"
gagaagucauuuaauaagtccacu

SEQ ID NO: 604 - RNA, 24 nt, Artificial Sequence
  source: /note="Description of Artificial Sequence: Synthetic oligonucleotide"
gagaagucauuuaauaaggccaau

SEQ ID NO: 605 - RNA, 43 nt, Artificial Sequence; identical to SEQ ID NO: 587
  source: /note="Description of Artificial Sequence: Synthetic oligonucleotide"

SEQ ID NO: 606 - RNA, 19 nt, Artificial Sequence
  source: /note="Description of Artificial Sequence: Synthetic oligonucleotide"
aauuucugcuguugcagau

SEQ ID NO: 607 - RNA, 19 nt, Artificial Sequence
  source: /note="Description of Artificial Sequence: Synthetic oligonucleotide"
aauuuccacuguuguggau

SEQ ID NO: 608 - RNA, 19 nt, Artificial Sequence
  source: /note="Description of Artificial Sequence: Synthetic oligonucleotide"
aauuccuacuguuguaggu

SEQ ID NO: 609 - RNA, 19 nt, Artificial Sequence
  source: /note="Description of Artificial Sequence: Synthetic oligonucleotide"
aauuuauacuguuguagau

SEQ ID NO: 610 - RNA, 19 nt, Artificial Sequence
  source: /note="Description of Artificial Sequence: Synthetic oligonucleotide"
aauuucgacuguuguagau

SEQ ID NO: 611 - RNA, 19 nt, Artificial Sequence
  source: /note="Description of Artificial Sequence: Synthetic oligonucleotide"
aauuucuaguguuguagau

SEQ ID NO: 612 - RNA, 19 nt, Artificial Sequence
  source: /note="Description of Artificial Sequence: Synthetic oligonucleotide"
aauuucaucuauuguagau

SEQ ID NO: 613 - RNA, 19 nt, Artificial Sequence
  source: /note="Description of Artificial Sequence: Synthetic oligonucleotide"
aauuucaucugcuguagau

SEQ ID NO: 614 - RNA, 18 nt, Artificial Sequence
  source: /note="Description of Artificial Sequence: Synthetic oligonucleotide"
aauuucaucuuuguagau

SEQ ID NO: 615 - RNA, 17 nt, Artificial Sequence
  source: /note="Description of Artificial Sequence: Synthetic oligonucleotide"
aauuucaucuuguagau

SEQ ID NO: 616 - RNA, 19 nt, Artificial Sequence
  source: /note="Description of Artificial Sequence: Synthetic oligonucleotide"
aauuucuacuuuuguagaa

SEQ ID NO: 617 - RNA, 19 nt, Artificial Sequence
  source: /note="Description of Artificial Sequence: Synthetic oligonucleotide"
aauuucuacuuuuguagac

SEQ ID NO: 618 - RNA, 36 nt, Artificial Sequence; identical to SEQ ID NO: 49
  source: /note="Description of Artificial Sequence: Synthetic oligonucleotide"

SEQ ID NO: 619 - RNA, 36 nt, Artificial Sequence; identical to SEQ ID NO: 468
  source: /note="Description of Artificial Sequence: Synthetic oligonucleotide"

SEQ ID NO: 620 - RNA, 35 nt, Artificial Sequence; identical to SEQ ID NO: 470
  source: /note="Description of Artificial Sequence: Synthetic oligonucleotide"

SEQ ID NO: 621 - RNA, 36 nt, Artificial Sequence; identical to SEQ ID NO: 472
  source: /note="Description of Artificial Sequence: Synthetic oligonucleotide"

SEQ ID NO: 622 - RNA, 36 nt, Artificial Sequence; identical to SEQ ID NO: 474
  source: /note="Description of Artificial Sequence: Synthetic oligonucleotide"

SEQ ID NO: 623 - RNA, 32 nt, Artificial Sequence; identical to SEQ ID NO: 476
  source: /note="Description of Artificial Sequence: Synthetic oligonucleotide"

SEQ ID NO: 624 - RNA, 35 nt, Artificial Sequence; identical to SEQ ID NO: 478
  source: /note="Description of Artificial Sequence: Synthetic oligonucleotide"

SEQ ID NO: 625 - RNA, 36 nt, Artificial Sequence; identical to SEQ ID NO: 480
  source: /note="Description of Artificial Sequence: Synthetic oligonucleotide"

SEQ ID NO: 626 - RNA, 35 nt, Artificial Sequence; identical to SEQ ID NO: 481
  source: /note="Description of Artificial Sequence: Synthetic oligonucleotide"

SEQ ID NO: 627 - RNA, 36 nt, Artificial Sequence; identical to SEQ ID NO: 479
  source: /note="Description of Artificial Sequence: Synthetic oligonucleotide"

SEQ ID NO: 628 - RNA, 36 nt, Artificial Sequence; identical to SEQ ID NO: 477
  source: /note="Description of Artificial Sequence: Synthetic oligonucleotide"

SEQ ID NO: 629 - RNA, 36 nt, Artificial Sequence; identical to SEQ ID NO: 475
  source: /note="Description of Artificial Sequence: Synthetic oligonucleotide"

SEQ ID NO: 630 - RNA, 36 nt, Artificial Sequence; identical to SEQ ID NO: 473
  source: /note="Description of Artificial Sequence: Synthetic oligonucleotide"

SEQ ID NO: 631 - RNA, 36 nt, Artificial Sequence; identical to SEQ ID NO: 471
  source: /note="Description of Artificial Sequence: Synthetic oligonucleotide"

SEQ ID NO: 632 - RNA, 36 nt, Artificial Sequence; identical to SEQ ID NO: 469
  source: /note="Description of Artificial Sequence: Synthetic oligonucleotide"

SEQ ID NO: 633 - RNA, 36 nt, Artificial Sequence; identical to SEQ ID NO: 467
  source: /note="Description of Artificial Sequence: Synthetic oligonucleotide"

SEQ ID NO: 634 - RNA, 20 nt, Artificial Sequence
  source: /note="Description of Artificial Sequence: Synthetic oligonucleotide"
uaauuucuacuguuguagau

SEQ ID NO: 635 - RNA, 20 nt, Artificial Sequence
  source: /note="Description of Artificial Sequence: Synthetic oligonucleotide"
gaaaugcaugguucucaugc

SEQ ID NO: 636 - RNA, 20 nt, Artificial Sequence
  source: /note="Description of Artificial Sequence: Synthetic oligonucleotide"
aaauuaccuaguaauuaggu

SEQ ID NO: 637 - RNA, 32 nt, Artificial Sequence; identical to SEQ ID NO: 476
  source: /note="Description of Artificial Sequence: Synthetic oligonucleotide"

SEQ ID NO: 638 - DNA, 36 bp, Artificial Sequence
  source: /note="Description of Artificial Sequence: Synthetic oligonucleotide"
aatgtttcctgatggtccatgtctgttactcgcctg

SEQ ID NO: 639 - RNA, 23 nt, Artificial Sequence
  source: /note="Description of Artificial Sequence: Synthetic oligonucleotide"
cugaugguccaugucuguuacuc

SEQ ID NO: 640 - DNA, 20 bp, Artificial Sequence
  source: /note="Description of Artificial Sequence: Synthetic oligonucleotide"
aatgtttcctgactcgcctg

SEQ ID NO: 641 - DNA, 12 bp, Artificial Sequence
  source: /note="Description of Artificial Sequence: Synthetic oligonucleotide"
aatgtttcctga

SEQ ID NO: 642 - DNA, 32 bp, Artificial Sequence
  source: /note="Description of Artificial Sequence: Synthetic oligonucleotide"
aatgtttcctgatggtccatgtctgtcgcctg

SEQ ID NO: 643 - DNA, 32 bp, Artificial Sequence; identical to SEQ ID NO: 642
  source: /note="Description of Artificial Sequence: Synthetic oligonucleotide"

SEQ ID NO: 644 - DNA, 30 bp, Artificial Sequence
  source: /note="Description of Artificial Sequence: Synthetic oligonucleotide"
aatgtttcctgatggtccatgttgtgcctg

SEQ ID NO: 645 - DNA, 31 bp, Artificial Sequence
  source: /note="Description of Artificial Sequence: Synthetic oligonucleotide"
aatgtttcctgatggtccatgtactcgcctg

SEQ ID NO: 646 - DNA, 32 bp, Artificial Sequence; identical to SEQ ID NO: 642
  source: /note="Description of Artificial Sequence: Synthetic oligonucleotide"

SEQ ID NO: 647 - DNA, 32 bp, Artificial Sequence
  source: /note="Description of Artificial Sequence: Synthetic oligonucleotide"
aatgtttcctgatggtccatgttactcgcctg

SEQ ID NO: 648 - DNA, 33 bp, Artificial Sequence
  source: /note="Description of Artificial Sequence: Synthetic oligonucleotide"
aatgtttcctgatggtccatgtctgttcgcctg

SEQ ID NO: 649 - DNA, 34 bp, Artificial Sequence
  source: /note="Description of Artificial Sequence: Synthetic oligonucleotide"
aatgtttcctgatggtccatgtcttactcgcctg

SEQ ID NO: 650 - DNA, 27 bp, Artificial Sequence
  source: /note="Description of Artificial Sequence: Synthetic oligonucleotide"
tttccctcactcctgctcggtgaattt

SEQ ID NO: 651 - DNA, 27 bp, Artificial Sequence
  source: /note="Description of Artificial Sequence: Synthetic oligonucleotide"
tttgaggagtgttcagtctccgtgaac

SEQ ID NO: 652 - DNA, 27 bp, Artificial Sequence
  source: /note="Description of Artificial Sequence: Synthetic oligonucleotide"
tttcctgatggtccatgtctgttactc

SEQ ID NO: 653 - DNA, 27 bp, Artificial Sequence
  source: /note="Description of Artificial Sequence: Synthetic oligonucleotide"
tttatttcccttcagctaaaataaagg

SEQ ID NO: 654 - DNA, 23 bp, Artificial Sequence
  source: /note="Description of Artificial Sequence: Synthetic oligonucleotide"
tcactcctgctcggtgaatttgg

SEQ ID NO: 655 - DNA, 23 bp, Artificial Sequence
  source: /note="Description of Artificial Sequence: Synthetic oligonucleotide"
aaccctctggggaccgtttgagg

SEQ ID NO: 656 - DNA, 23 bp, Artificial Sequence
  source: /note="Description of Artificial Sequence: Synthetic oligonucleotide"
agtacgttaatgtttcctgatgg

SEQ ID NO: 657 - DNA, 23 bp, Artificial Sequence
  source: /note="Description of Artificial Sequence: Synthetic oligonucleotide"
tttcccttcagctaaaataaagg

SEQ ID NO: 658 - DNA, 35 bp, Artificial Sequence
  source: /note="Description of Artificial Sequence: Synthetic oligonucleotide"
tttggagaagtcatttaataaggccactgttaaaa

SEQ ID NO: 659 - DNA, 35 bp, Artificial Sequence
  source: /note="Description of Artificial Sequence: Synthetic oligonucleotide"
tttagagaagtcatttaataaggccactgttaaaa

SEQ ID NO: 660 - DNA, 14 bp, Artificial Sequence
  source: /note="Description of Artificial Sequence: Synthetic oligonucleotide"
  modified_base (1)..(1): a, c, t, g, unknown or other
ngccactgttaaaa

SEQ ID NO: 661 - DNA, 14 bp, Artificial Sequence
  source: /note="Description of Artificial Sequence: Synthetic oligonucleotide"
  modified_base (1)..(1): a, c, t, g, unknown or other
ngccactgttaaaa

SEQ ID NO: 662 - DNA, 28 bp, Artificial Sequence
  source: /note="Description of Artificial Sequence: Synthetic oligonucleotide"
  modified_base (28)..(28): a, c, t, g, unknown or other
tttggagaagtcatttaataaggccacn

SEQ ID NO: 663 - DNA, 28 bp, Artificial Sequence
  source: /note="Description of Artificial Sequence: Synthetic oligonucleotide"
  modified_base (28)..(28): a, c, t, g, unknown or other
tttagagaagtcatttaataaggccacn

SEQ ID NO: 664 - DNA, 35 bp, Artificial Sequence
  source: /note="Description of Artificial Sequence: Synthetic oligonucleotide"
tttcgagaagtcatttaataaggccactgttaaaa

SEQ ID NO: 665 - DNA, 14 bp, Artificial Sequence
  source: /note="Description of Artificial Sequence: Synthetic oligonucleotide"
  modified_base (1)..(1): a, c, t, g, unknown or other
ngccactgttaaaa

SEQ ID NO: 666 - DNA, 28 bp, Artificial Sequence
  source: /note="Description of Artificial Sequence: Synthetic oligonucleotide"
  modified_base (28)..(28): a, c, t, g, unknown or other
tttcgagaagtcatttaataaggccacn

SEQ ID NO: 667 - DNA, 35 bp, Artificial Sequence
  source: /note="Description of Artificial Sequence: Synthetic oligonucleotide"
tttggctactattcctgtgccttcagataattcaa

SEQ ID NO: 668 - DNA, 35 bp, Artificial Sequence
  source: /note="Description of Artificial Sequence: Synthetic oligonucleotide"
ttttgctactattcctgtgccttcagataattcaa

SEQ ID NO: 669 - DNA, 15 bp, Artificial Sequence
  source: /note="Description of Artificial Sequence: Synthetic oligonucleotide"
  modified_base (1)..(1): a, c, t, g, unknown or other
nttcagataattcaa

SEQ ID NO: 670 - DNA, 15 bp, Artificial Sequence
  source: /note="Description of Artificial Sequence: Synthetic oligonucleotide"
  modified_base (1)..(1): a, c, t, g, unknown or other
nttcagataattcaa

SEQ ID NO: 671 - DNA, 28 bp, Artificial Sequence
  source: /note="Description of Artificial Sequence: Synthetic oligonucleotide"
  modified_base (28)..(28): a, c, t, g, unknown or other
tttggctactattcctgtgccttcagan

SEQ ID NO: 672 - DNA, 27 bp, Artificial Sequence
  source: /note="Description of Artificial Sequence: Synthetic oligonucleotide"
ttttgctactattcctgtgccttcaga

SEQ ID NO: 673 - DNA, 35 bp, Artificial Sequence
  source: /note="Description of Artificial Sequence: Synthetic oligonucleotide"
tttcgtctagagccttttgtattagtagccgagct

SEQ ID NO: 674 - DNA, 35 bp, Artificial Sequence
  source: /note="Description of Artificial Sequence: Synthetic oligonucleotide"
tttggtctagagccttttgtattagtagccgagct

SEQ ID NO: 675 - DNA, 15 bp, Artificial Sequence
  source: /note="Description of Artificial Sequence: Synthetic oligonucleotide"
  modified_base (1)..(1): a, c, t, g, unknown or other
nttagtagccgagct

SEQ ID NO: 676 - DNA, 15 bp, Artificial Sequence
  source: /note="Description of Artificial Sequence: Synthetic oligonucleotide"
  modified_base (1)..(1): a, c, t, g, unknown or other
nttagtagccgagct

SEQ ID NO: 677 - DNA, 28 bp, Artificial Sequence
  source: /note="Description of Artificial Sequence: Synthetic oligonucleotide"
  modified_base (28)..(28): a, c, t, g, unknown or other
tttcgtctagagccttttgtattagtan

SEQ ID NO: 678 - DNA, 28 bp, Artificial Sequence
  source: /note="Description of Artificial Sequence: Synthetic oligonucleotide"
  modified_base (28)..(28): a, c, t, g, unknown or other
tttggtctagagccttttgtattagtan

SEQ ID NO: 679 - DNA, 35 bp, Artificial Sequence
  source: /note="Description of Artificial Sequence: Synthetic oligonucleotide"
tttctggcaccaggaatccccaacatgcactgatg

SEQ ID NO: 680 - DNA, 35 bp, Artificial Sequence
  source: /note="Description of Artificial Sequence: Synthetic oligonucleotide"
ctttgtcctccggttctggaaccacaccttcacct

SEQ ID NO: 681 - DNA, 14 bp, Artificial Sequence
  source: /note="Description of Artificial Sequence: Synthetic oligonucleotide"
  modified_base (1)..(2): a, c, t, g, unknown or other
nncatgcactgatg

SEQ ID NO: 682 - DNA, 14 bp, Artificial Sequence
  source: /note="Description of Artificial Sequence: Synthetic oligonucleotide"
  modified_base (1)..(1): a, c, t, g, unknown or other
ncacaccttcacct

SEQ ID NO: 683 - DNA, 28 bp, Artificial Sequence
  source: /note="Description of Artificial Sequence: Synthetic oligonucleotide"
  modified_base (27)..(28): a, c, t, g, unknown or other
aaagaccgtggtccttaggggttgtann

SEQ ID NO: 684 - DNA, 28 bp, Artificial Sequence
  source: /note="Description of Artificial Sequence: Synthetic oligonucleotide"
  modified_base (28)..(28): a, c, t, g, unknown or other
ctttgtcctccggttctggaaccacacn

SEQ ID NO: 685 - RNA, 43 nt, Artificial Sequence; identical to SEQ ID NO: 587
  source: /note="Description of Artificial Sequence: Synthetic oligonucleotide"

SEQ ID NO: 686 - DNA, 24 bp, Artificial Sequence
  source: /note="Description of Artificial Sequence: Synthetic oligonucleotide"
  source: /note="Description of Combined DNA/RNA Molecule: Synthetic oligonucleotide"
tagaagucauuuaauaaggccacu

SEQ ID NO: 687 - DNA, 24 bp, Artificial Sequence
  source: /note="Description of Artificial Sequence: Synthetic oligonucleotide"
  source: /note="Description of Combined DNA/RNA Molecule: Synthetic oligonucleotide"
gataagucauuuaauaaggccacu

SEQ ID NO: 688 - RNA, 24 nt, Artificial Sequence
  source: /note="Description of Artificial Sequence: Synthetic oligonucleotide"
gagacgucauuuaauaaggccacu

SEQ ID NO: 689 - RNA, 24 nt, Artificial Sequence
  source: /note="Description of Artificial Sequence: Synthetic oligonucleotide"
gagaaggcauuuaauaaggccacu

SEQ ID NO: 690 - RNA, 24 nt, Artificial Sequence
  source: /note="Description of Artificial Sequence: Synthetic oligonucleotide"
gagaaguccuuuaauaaggccacu

SEQ ID NO: 691 - RNA, 24 nt, Artificial Sequence
  source: /note="Description of Artificial Sequence: Synthetic oligonucleotide"
gagaagucauguaauaaggccacu

SEQ ID NO: 692 - RNA, 24 nt, Artificial Sequence
  source: /note="Description of Artificial Sequence: Synthetic oligonucleotide"
gagaagucauuucauaaggccacu

SEQ ID NO: 693 - RNA, 24 nt, Artificial Sequence
  source: /note="Description of Artificial Sequence: Synthetic oligonucleotide"
gagaagucauuuaagaaggccacu

SEQ ID NO: 694 - RNA, 24 nt, Artificial Sequence
  source: /note="Description of Artificial Sequence: Synthetic oligonucleotide"
gagaagucauuuaauacggccacu

SEQ ID NO: 695 - DNA, 24 bp, Artificial Sequence
  source: /note="Description of Artificial Sequence: Synthetic oligonucleotide"
  source: /note="Description of Combined DNA/RNA Molecule: Synthetic oligonucleotide"
gagaagucauuuaauaagtccacu

SEQ ID NO: 696 - RNA, 24 nt, Artificial Sequence
  source: /note="Description of Artificial Sequence: Synthetic oligonucleotide"
gagaagucauuuaauaaggcaacu

SEQ ID NO: 697 - RNA, 24 nt, Artificial Sequence
  source: /note="Description of Artificial Sequence: Synthetic oligonucleotide"
gagaagucauuuaauaaggccaau

SEQ ID NO: 698 - protein, 724 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFY

SEQ ID NO: 699 - protein, 680 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFT

SEQ ID NO: 700 - protein, 639 aa, Unknown
  source: /note="Description of Unknown: Lachnospiraceae bacterium sequence"
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFF

SEQ ID NO: 701 - protein, 468 aa, Francisella tularensis
RKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 702 - protein, 518 aa, Acidaminococcus sp.
RPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 703 - protein, 482 aa, Unknown
  source: /note="Description of Unknown: Lachnospiraceae bacterium sequence"
RRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 704 - RNA, 44 nt, Francisella tularensis
  modified_base (21)..(44): a, c, u, g, unknown or other
uaauuucuacuguuguagaunnnnnnnnnnnnnnnnnnnnnnnn

SEQ ID NO: 705 - RNA, 44 nt, Unknown
  source: /note="Description of Unknown: Lachnospiraceae bacterium sequence"
  modified_base (21)..(44): a, c, u, g, unknown or other
gaaaugcaugguucucaugcnnnnnnnnnnnnnnnnnnnnnnnn

SEQ ID NO: 706 - RNA, 44 nt, Butyrivibrio proteoclasticus
  modified_base (21)..(44): a, c, u, g, unknown or other
aaauuaccuaguaauuaggunnnnnnnnnnnnnnnnnnnnnnnn

SEQ ID NO: 707 - RNA, 44 nt, Unknown
  source: /note="Description of Unknown: Candidatus Peregrinibacteria bacterium sequence"
  modified_base (21)..(44): a, c, u, g, unknown or other
ggauuucuacuuuuguagaunnnnnnnnnnnnnnnnnnnnnnnn

SEQ ID NO: 708 - RNA, 44 nt, Unknown
  source: /note="Description of Unknown: Candidatus Peregrinibacteria bacterium sequence"
  modified_base (21)..(44): a, c, u, g, unknown or other
aaauuucuacuuuuguagaunnnnnnnnnnnnnnnnnnnnnnnn

SEQ ID NO: 709 - RNA, 44 nt, Smithella sp.
  modified_base (21)..(44): a, c, u, g, unknown or other
gcgcccacgcggggcgcgacnnnnnnnnnnnnnnnnnnnnnnnn

SEQ ID NO: 710 - RNA, 44 nt, Acidaminococcus sp.
  modified_base (21)..(44): a, c, u, g, unknown or other
uaauuucuacucuuguagaunnnnnnnnnnnnnnnnnnnnnnnn

SEQ ID NO: 711 - RNA, 44 nt, Unknown
  source: /note="Description of Unknown: Lachnospiraceae bacterium sequence"
  modified_base (21)..(44): a, c, u, g, unknown or other
gaauuucuacuauuguagaunnnnnnnnnnnnnnnnnnnnnnnn

SEQ ID NO: 712 - RNA, 45 nt, Unknown
  source: /note="Description of Unknown: Candidatus Methanoplasma termitum sequence"
  modified_base (22)..(45): a, c, u, g, unknown or other
gaaucucuacucuuuguagaunnnnnnnnnnnnnnnnnnnnnnnn

SEQ ID NO: 713 - RNA, 43 nt, Eubacterium eligens
  modified_base (20)..(43): a, c, u, g, unknown or other
uaauuucuacuuuguagaunnnnnnnnnnnnnnnnnnnnnnnn

SEQ ID NO: 714 - RNA, 44 nt, Moraxella bovoculi
  modified_base (21)..(44): a, c, u, g, unknown or other
aauuucuacuguuuguagaunnnnnnnnnnnnnnnnnnnnnnnn

SEQ ID NO: 715 - RNA, 44 nt, Leptospira inadai
  modified_base (21)..(44): a, c, u, g, unknown or other
gaauuucuacuuuuguagaunnnnnnnnnnnnnnnnnnnnnnnn

SEQ ID NO: 716 - RNA, 44 nt, Unknown
  source: /note="Description of Unknown: Lachnospiraceae bacterium sequence"
  modified_base (21)..(44): a, c, u, g, unknown or other
aauuucuacuaaguguagaunnnnnnnnnnnnnnnnnnnnnnnn

SEQ ID NO: 717 - RNA, 44 nt, Porphyromonas crevioricanis
  modified_base (21)..(44): a, c, u, g, unknown or other
uaauuucuacuauuguagaunnnnnnnnnnnnnnnnnnnnnnnn

SEQ ID NO: 718 - RNA, 44 nt, Prevotella disiens
  modified_base (21)..(44): a, c, u, g, unknown or other
uaauuucuacuucgguagaunnnnnnnnnnnnnnnnnnnnnnnn

SEQ ID NO: 719 - RNA, 44 nt, Porphyromonas macacae; identical to SEQ ID NO: 717
  modified_base (21)..(44): a, c, u, g, unknown or other

SEQ ID NO: 720 - DNA, 35 bp, Artificial Sequence
  source: /note="Description of Artificial Sequence: Synthetic oligonucleotide"
ttttgagaagtcatttaataaggccactgttaaaa

SEQ ID NO: 721 - DNA, 13 bp, Artificial Sequence
  source: /note="Description of Artificial Sequence: Synthetic primer"
  modified_base (1)..(1): a, c, t, g, unknown or other
nccactgttaaaa

SEQ ID NO: 722 - DNA, 28 bp, Artificial Sequence
  source: /note="Description of Artificial Sequence: Synthetic primer"
  modified_base (28)..(28): a, c, t, g, unknown or other
ttttgagaagtcatttaataaggccacn

SEQ ID NO: 723 - DNA, 35 bp, Artificial Sequence; identical to SEQ ID NO: 720
  source: /note="Description of Artificial Sequence: Synthetic oligonucleotide"

SEQ ID NO: 724 - DNA, 13 bp, Artificial Sequence
  source: /note="Description of Artificial Sequence: Synthetic primer"
  modified_base (1)..(1): a, c, t, g, unknown or other
nccactgttaaaa

SEQ ID NO: 725 - DNA, 28 bp, Artificial Sequence
  source: /note="Description of Artificial Sequence: Synthetic primer"
  modified_base (28)..(28): a, c, t, g, unknown or other
ttttgagaagtcatttaataaggccacn

SEQ ID NO: 726 - protein, 1307 aa, Acidaminococcus sp.; identical to SEQ ID NO: 77

SEQ ID NO: 727 - protein, 365 aa, Thermotoga maritima
MRPERLTVRNFLGLKNVDIEFQSGITVVEGPNGAGKSSLFEAISFALFGNGIRYPNSYDYVNRNAVDGTARLVFQFERGGKRYEIIREINALQRKHNAKLSEILENGKKAAIAAKPTSVKQEVEKILGIEHRTFIRTVFLPQGEIDKLLISPPSEITEIISDVFQSKETLEKLEKLLKEKMKKLENEISSGGAGGAGGSLEKKLKEMSDEYNNLDLLRKYLFDKSNFSRYFTGRVLEAVLKRTKAYLDILTNGRFDIDFDDEKGGFIIKDWGIERPARGLSGGERALISISLAMSLAEVASGRLDAFFIDEGFSSLDTENKEKIASVLKELERLNKVIVFITHDREFSEAFDRKLRITGGVVVNE

SEQ ID NO: 728 - protein, 1307 aa, Acidaminococcus sp.; identical to SEQ ID NO: 77

SEQ ID NO: 729 - protein, 169 aa, Artificial Sequence
  source: /note="Description of Artificial Sequence: Synthetic polypeptide"
GPHMVVAGIDPGITHLGLGVVAVEGKGALKARLLHGEVVKTSPQEPAKERVGRIHARVLEVLHRFRPEAVAVQEQFFYRQNELAYKVGWALGAVLVAAFEAGVPVYAYGPMQVKQALAGHGHAAKEEVALMVRGILGLKEAPRPSHLADALAIALTHAFYARMGTAKPL

SEQ ID NO: 730 - protein, 1307 aa, Acidaminococcus sp.; identical to SEQ ID NO: 77

SEQ ID NO: 731 - protein, 1300 aa, Francisella tularensis; identical to SEQ ID NO: 51

SEQ ID NO: 732 - protein, 119 aa, Artificial Sequence
  source: /note="Description of Artificial Sequence: Synthetic polypeptide"
FAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDK

SEQ ID NO: 733 - protein, 118 aa, Roseburia intestinalis
FREGVKDKPLSYICFEVLYWTGMREGELLALSPADIDIDNKLISINRTYQRIGGKDVFTSPKTRKSKRTIPIPDFLCQELSDYIQSRYMLDADERLFPVTKSYLSHEMIRGCKITGAK

SEQ ID NO: 734 - protein, 44 aa, Artificial Sequence
  source: /note="Description of Artificial Sequence: Synthetic consensus sequence"
  MOD_RES (16)..(16): Any amino acid
PYSKGKPNLHTLYWKXLFSERNLKDVVYKLNGEAEIFYRKKSIK

SEQ ID NO: 735 - protein, 44 aa, Francisella tularensis
AYSKGRPNLHTLYWKALFDERNLQDVVYKLNGEAELFYRKQSIP

SEQ ID NO: 736 - protein, 48 aa, Unknown
  source: /note="Description of Unknown: Lachnospiraceae bacterium sequence"
SYYKYGNEKVLRGYEGVLLSILKDENLVSMRTLLNSRPMLVYRPKESS

SEQ ID NO: 737 - protein, 36 aa, Butyrivibrio proteoclasticus
PYERTFIQLFSDSNMEHTSMLLNSRAMIQYRAASLP

SEQ ID NO: 738 - protein, 59 aa, Unknown
  source: /note="Description of Unknown: Candidatus Falkowbacteria bacterium sequence"
DFERKSEDKKNHTANLFTQYLLELFSCENIKNIKSKDLIESIFELDGKAEIRFRPKTDD

SEQ ID NO: 739 - protein, 43 aa, Unknown
  source: /note="Description of Unknown: Candidatus Peregrinibacteria bacterium sequence"
DGKSIGHKNNLHTIYWNAIFENFDNRPKLNGEAEIFYRKAISK

SEQ ID NO: 740 - protein, 44 aa, Unknown
  source: /note="Description of Unknown: candidate division WS6 bacterium sequence"
GKKSGKDNIHTIYWKYLFSESNCKSPIIGLNGGAEIFFREGQKD

SEQ ID NO: 741 - protein, 46 aa, Unknown
  source: /note="Description of Unknown: uncultured bacterium sequence"
ESKKEWSTENIHTKYFKLLFNEKNLQNLVVKLSWWADIFFRDKTEN

SEQ ID NO: 742 - protein, 52 aa, Unknown
  source: /note="Description of Unknown: Parcubacteria group bacterium sequence"
LDKARDGKSKTTQKNLHTLYFESLFSNDNVVQNFPIKLNGQAEIFYRPKTEK

SEQ ID NO: 743 - protein, 44 aa, Unknown
  source: /note="Description of Unknown: Parcubacteria group bacterium sequence"
NTKNGSKNLHTLYFEHILSAENLNDPVFKLSGMAEIFQRQPSVN

SEQ ID NO: 744 - protein, 44 aa, Helcococcus kunzii; identical to SEQ ID NO: 743

SEQ ID NO: 745 - protein, 44 aa, Unknown
  source: /note="Description of Unknown: Candidatus Methanomethylophilus alvus sequence"
PESKGKKNLHTLYWLSMFSEENLRTRKLKLNGQAEIFYRKKLEK

SEQ ID NO: 746 - protein, 44 aa, Acidaminococcus sp.
ENAHGNKNMHTMYWEGLFSPQNLESPVFKLSGGAELFFRKSSIP

SEQ ID NO: 747 - protein, 44 aa, Succinivibrio dextrinosolvens
KGHHGKPNLHTLYWTGLFSPENLAKTSIKLNGQAELFYRPKSRM

SEQ ID NO: 748 - protein, 44 aa, Eubacterium sp.
SKSTGTKNLHTLYLQAIFDERNLNNPTIMLNGGAELFYRKESIE

SEQ ID NO: 749 - protein, 44 aa, Eubacterium eligens
AHSTGRDNLHTMYLKNIFSEDNLKNICIELNGEAELFYRKSSMK

SEQ ID NO: 750 - protein, 44 aa, Eubacterium eligens
ENSTGKENLHTMYFKNIFSEENLKNIVIKLNGQAELFYRKASVK

SEQ ID NO: 751 - protein, 44 aa, Proteocatellas phenisci
ENSTGKENLHTMYFKNIFSEENLKDIIIKLNGQAELFYRRASVK

SEQ ID NO: 752 - protein, 44 aa, Anaerovibriosp.
IDSKGTKNLNTIYFESLFSEENMIEKMFKLSGEAEIFYRPASLN

SEQ ID NO: 753 - protein, 52 aa, Prevotella disiens
DKKKKKGTDNLHTMYWHGVFSDENLKAVTEGTQPIIKLNGEAEMFMRNPSIE

SEQ ID NO: 754 - protein, 47 aa, Porphyromonas macacae
KTFSANLRKKRGAENLHTMLFKALMEGNQDNLDLGSGAIFYRAKSLD

SEQ ID NO: 755 - protein, 43 aa, Unknown
  source: /note="Description of Unknown: Candidatus Methanoplasma termitum sequence"
PYSKGIPNLHTLYWKALFSEQNQSRVYKLCGGGELFYRKASLH

SEQ ID NO: 756 - protein, 44 aa, Synergistes jonesii
KAATGKKDMHTIYWNAAFSPENLQDVVVKLNGEAELFYRDKSDI

SEQ ID NO: 757 - protein, 44 aa, Unknown
  source: /note="Description of Unknown: Lachnospiraceae bacterium sequence"
DGAQGSPNLHTLYWKAIFSEENLKDVVLKLNGEAELFFRRKSID

SEQ ID NO: 758 - protein, 42 aa, Unknown
  source: /note="Description of Unknown: Lachnospiraceae bacterium sequence"
DKSHGTPNLHTMYFKLLFDENNHGQIRLSGGAELFMRRASLK

SEQ ID NO: 759 - protein, 44 aa, Francisella tularensis
EHSKGKPNLHTVYWNALFSEYNLQNTVYQLNGSAEIFFRKASIP

SEQ ID NO: 760 - protein, 44 aa, Francisella tularensis; identical to SEQ ID NO: 735

SEQ ID NO: 761 - protein, 44 aa, Francisella tularensis
AYSKGRPNLHTLYWKALFDERNLQDVVYKLNGEAELFYRKKSIP

SEQ ID NO: 762 - protein, 44 aa, Francisella tularensis; identical to SEQ ID NO: 735

SEQ ID NO: 763 - protein, 44 aa, Francisella tularensis; identical to SEQ ID NO: 735

SEQ ID NO: 764 - protein, 44 aa, Unknown
  source: /note="Description of Unknown: Lachnospiraceae bacterium sequence"
EYATGNLNLHTLYLKMLFDERNLKDLCIKMNGEAEVFYRPASIL

SEQ ID NO: 765 - protein, 44 aa, Butyrivibrio fibrisolvens
EYSKGRLNLHTLYFKMLFDERNLKNVVYKLNGQAEVFYRPSSIK

SEQ ID NO: 766 - protein, 44 aa, Pseudobutyrivibrio ruminis
PYSKGNLNLHTIYLQMLFDQRNLNNVVYKLNGEAEVFYRPASIN

SEQ ID NO: 767 - protein, 44 aa, Oribacterium sp.
PYSKGKLNLHTLYFKMLFDQRNLDNVVYKLNGEAEVFYRPASIE

SEQ ID NO: 768 - protein, 44 aa, Unknown
  source: /note="Description of Unknown: Lachnospiraceae bacterium sequence"
MYSKGKLNLHTLYFMMLFDQRNIDDVVYKLNGEAEVFYRPASIS

SEQ ID NO: 769 - protein, 44 aa, Butyrivibrio sp.
EYSKGKLNLHTLYFMMLFDQRNLDNVVYKLNGEAEVFYRPASIA

SEQ ID NO: 770 - protein, 44 aa, Moraxella caprae
PKAHGKPNLHTLYFKALFSKDNLANPIYKLNGEAQIFYRKASLD

SEQ ID NO: 771 - protein, 44 aa, Moraxella bovoculi
PKAHGKPNLHTLYFKALFSEDNLADPIYKLNGEAQIFYRKASLD

SEQ ID NO: 772 - protein, 44 aa, Leptospira inadai
IFSKGKPNLHTIYFRSLFSKENLKDVCLKLNGEAEMFFRKKSIN

SEQ ID NO: 773 - protein, 44 aa, Unknown
  source: /note="Description of Unknown: Lachnospiraceae bacterium sequence"
PYSKGTKNLHTLYWEMLFSQQNLQNIVYKLNGNAEIFYRKASIN

SEQ ID NO: 774 - protein, 44 aa, Smithella sp.
PFSKGKPNLHTLYWKMLFDENNLKDVVYKLNGEAEVFYRKKSIA

SEQ ID NO: 775 - protein, 44 aa, Smithella sp.; identical to SEQ ID NO: 774

SEQ ID NO: 776 - protein, 44 aa, Flavobacterium sp.
PYAKGKPNMHTLYWKALFETQNLENVIYKLNGQAEIFFRKASIK

SEQ ID NO: 777 - protein, 44 aa, Flavobacterium branchiophilum
PFSKGKPNMHTLYWKALFEEQNLQNVIYKLNGQAEIFFRKASIK

SEQ ID NO: 778 - protein, 44 aa, Porphyromonas crevioricanis
PCSKGTPNLHTLYWRMLFDERNLADVIYKLDGKAEIFFREKSLK

SEQ ID NO: 779 - protein, 44 aa, Porphyromonas crevioricanis; identical to SEQ ID NO: 778

SEQ ID NO: 780 - protein, 44 aa, Porphyromonas crevioricanis; identical to SEQ ID NO: 778

SEQ ID NO: 781 - protein, 44 aa, Porphyromonas crevioricanis; identical to SEQ ID NO: 778

SEQ ID NO: 782 - protein, 44 aa, Prevotella brevis
TYSKGTPNMHTLYWKMLFDESNLNDVVYKLNGQAEVFYRKKSIT

SEQ ID NO: 783 - protein, 44 aa, Unknown
  source: /note="Description of Unknown: Bacteroidetes oral taxon 274 sequence"
AHSKGTPNMHTLYWKMLFDEENLKDVVYKLNGEAEVFFRKSSIT

SEQ ID NO: 784 - protein, 44 aa, Prevotellaalbensis
QFSKGTPNLHTLYWKMLFDKRNLSDVVYKLNGQAEVFYRKSSIE

SEQ ID NO: 785 - protein, 44 aa, Prevotella bryantii
EFSKGTPNMHTLYWNSLFSKENLNNIIYKLNGQAEIFFRKKSLN

SEQ ID NO: 786 - protein, 44 aa, Prevotella bryantii; identical to SEQ ID NO: 785

SEQ ID NO: 787 - DNA, 45 bp, Artificial Sequence
  source: /note="Description of Artificial Sequence: Synthetic oligonucleotide"
gtaatttctactcttgtagatgaagagcgagctcttcttttttcg

SEQ ID NO: 788 - protein, 1206 aa, Unknown; identical to SEQ ID NO: 334
  source: /note="Description of Unknown: Lachnospiraceae bacterium polypeptide"

SEQ ID NO: 789 - protein, 5 aa, Artificial Sequence
  source: /note="Description of Artificial Sequence: Synthetic peptide"
GGGGS

SEQ ID NO: 790 - protein, 10 aa, Artificial Sequence
  source: /note="Description of Artificial Sequence: Synthetic peptide"
GGGGSGGGGS

SEQ ID NO: 791 - protein, 20 aa, Artificial Sequence
  source: /note="Description of Artificial Sequence: Synthetic peptide"
GGGGSGGGGSGGGGSGGGGS

SEQ ID NO: 792 - protein, 25 aa, Artificial Sequence
  source: /note="Description of Artificial Sequence: Synthetic peptide"
GGGGSGGGGSGGGGSGGGGSGGGGS

SEQ ID NO: 793 - protein, 35 aa, Artificial Sequence
  source: /note="Description of Artificial Sequence: Synthetic polypeptide"
GGGGSGGGGSGGGGSGGGGSGGGGSGGGGSGGGGS

SEQ ID NO: 794 - protein, 40 aa, Artificial Sequence
  source: /note="Description of Artificial Sequence: Synthetic polypeptide"
GGGGSGGGGSGGGGSGGGGSGGGGSGGGGSGGGGSGGGGS

SEQ ID NO: 795 - protein, 50 aa, Artificial Sequence
  source: /note="Description of Artificial Sequence: Synthetic polypeptide"
GGGGSGGGGSGGGGSGGGGSGGGGSGGGGSGGGGSGGGGSGGGGSGGGGS

SEQ ID NO: 796 - protein, 55 aa, Artificial Sequence
  source: /note="Description of Artificial Sequence: Synthetic polypeptide"
GGGGSGGGGSGGGGSGGGGSGGGGSGGGGSGGGGSGGGGSGGGGSGGGGSGGGGS

SEQ ID NO: 797 - protein, 12 aa, Artificial Sequence
  source: /note="Description of Artificial Sequence: Synthetic peptide"
GGGSGGGSGGGS

SEQ ID NO: 798 - protein, 7 aa, Artificial Sequence
  source: /note="Description of Artificial Sequence: Synthetic peptide"
AEAAAKA

What is claimed:

1. A composition comprising:
a non-naturally occurring or engineered guide RNA (gRNA) comprising a guide sequence capable of hybridizing to a target sequence in a genomic locus of interest in a cell, wherein the gRNA is capable of forming a complex with a Cpf1 effector protein, wherein the gRNA comprises a loop comprising an aptamer sequence that is capable of binding to an adaptor protein; and
a mutated Cpf1 effector protein, wherein the mutated Cpf1 effector protein comprises at least one mutation, such that the mutated Cpf1 effector protein has no more than 5% of the nuclease activity of a corresponding wild-type Cpf1 effector protein not having the at least one mutation, and wherein the mutated Cpf1 effector protein comprises one or more nuclear localization sequences.

2. The composition of claim 1, wherein the composition further comprises a fusion protein comprising an adaptor protein fused to one or more heterologous functional domains.

3. The composition of claim 2, wherein the mutated Cpf1 effector protein has a diminished nuclease activity of at least 97%, or 100% as compared with the corresponding wild-type Cpf1 effector protein not having the at least one mutation.

4. The composition of claim 2, wherein the mutated Cpf1 effector protein comprises at least one mutation selected from D908A, E993A, or D1263A according to AsCpf1 protein or a corresponding mutation in an ortholog.

5. The composition of claim 2, wherein the mutated Cpf1 effector protein comprises at least one mutation selected from D832A, E925A, D947A or D1180A according to LbCpf1 protein or a corresponding mutation in an ortholog.

6. The composition of claim 5, wherein the mutated Cpf1 effector protein comprises two or more mutations.

7. The composition of claim 2, wherein the mutated Cpf1 effector protein is fused to one or more heterologous functional domains.

8. The composition of claim 2, wherein the fusion protein comprises a linker between the adaptor protein and the heterologous functional domain, the linker optionally comprising a GlySer linker.

9. The composition of claim 2, wherein the one or more heterologous functional domains fused to the adaptor protein comprise a transcriptional activation domain.

10. The composition of claim 7, wherein the one or more heterologous functional domains fused to the mutated Cpf1 effector protein comprise a transcriptional activation domain.

11. The composition of claim 9, wherein the transcriptional activation domain is VP64, p65, MyoD1, HSF1, RTA or SET7/9.

12. The composition of claim 10, wherein the transcriptional activation domain is VP64, p65, MyoD1, HSF1, RTA or SET7/9.

13. The composition of claim 2, wherein the one or more heterologous functional domains fused to the adaptor protein comprise a transcriptional repressor domain.

14. The composition of claim 7, wherein the one or more heterologous functional domains fused to the mutated Cpf1 effector protein comprise a transcriptional repressor domain.

15. The composition of claim 13, wherein the transcriptional repressor domain is a KRAB domain.

16. The composition of claim 13, wherein the transcriptional repressor domain is a NuE domain, NcoR domain, SID domain or a SID4X domain.

17. The composition of claim 2, wherein at least one of the one or more heterologous functional domains fused to the adaptor protein has one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity.

18. The composition of claim 7, wherein at least one of the one or more heterologous functional domains fused to the mutated Cpf1 effector protein has one or more activities comprising methylase activity, demethylase activity, transcription activation activity, transcription repression activity, transcription release factor activity, histone modification activity, DNA integration activity RNA cleavage activity, DNA cleavage activity, nucleic acid binding activity, or molecular switch activity or chemical inducibility or light inducibility.

19. The composition of claim 2, wherein the adaptor protein is a bacteriophage coat protein selected from the group consisting of MS2, PP7, Qβ, GA, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, and PRR1.

20. The composition of claim 2, wherein the cell is a eukaryotic cell.

21. The composition of claim 20, wherein the eukaryotic cell is a mammalian cell.

22. The composition of claim 21, wherein the mammalian cell is a human cell.

23. The composition of claim 20, wherein the eukaryotic cell is a plant cell.

24. A non-human transgenic cell or cell line which has been transformed with the composition according to claim 2.

25. A non-human transgenic mammalian model, wherein the model has been transformed with the composition according to claim 2.

26. An isolated host cell or cell line comprising the composition of claim 2.

27. The isolated host cell or cell line according to claim 26, wherein the cell is a eukaryotic cell.

28. The isolated host cell or cell line according to claim 26, wherein the cell is an animal cell.

29. The isolated host cell or cell line according to claim 28, wherein the cell is a human cell.

30. The isolated host cell or cell line according to claim 26, comprising a stem cell or stem cell line.

31. The isolated host cell or cell line according to claim 26, wherein the cell is a plant cell.

32. A vector system comprising one or more vector(s) comprising nucleic acid molecule(s) encoding: a guide RNA (gRNA) and a mutated Cpf1 effector protein,
wherein the mutated Cpf1 effector protein comprises at least one mutation, such that the mutated Cpf1 effector protein has no more than 5% of the nuclease activity of a corresponding wild-type Cpf1 effector protein not having the at least one mutation, and wherein the mutated Cpf1 effector protein comprises at least one or more nuclear localization sequences, and
wherein the gRNA is a non-naturally occurring or engineered gRNA comprising a guide sequence capable of hybridizing to a target sequence in a genomic locus of interest in a cell, wherein the gRNA is capable of forming a complex with a Cpf1 effector protein, wherein the gRNA comprises a loop comprising an aptamer sequence that is capable of binding to an adaptor protein.

33. The vector system of claim 32, nucleic acid molecule(s) further encoding a fusion protein comprising an adaptor protein fused to one or more heterologous functional domains.

* * * * *